United States Patent 8,216,786 (GENETIC POLYMORPHISMS ASSOCIATED WITH CARDIOVASCULAR DISEASES, METHODS OF DETECTION AND USES THEREOF) - sequence listing, part 16

SEQ ID NO: 2933 - DNA, 201 bp, Homo sapiens
cccagatgcctttgtgcacaaactgacagctggtcctaaatttatatggaaataaaagaaacccaaaattgccaaaacaaatcttgaaacaggataaaagytggaagacccactcttctcaatttcaaaacttagccttcaaaggtaaagtaatttggtatagcagcggtccccaacctttctggcaccaaggactggttt

SEQ ID NO: 2934 - DNA, 201 bp, Homo sapiens
ccagtttacgggaaatacagagaacagtataatactattgcgaggaagccatcagacaaaaactagaaggcaggtcatgctatgtgccaaaatctcttacrggtcaatgtggtggataaattaacaagtaaaggcagtggactaagttttagtgtaaaaaagacttaagactaaaaggcaaagtctatttaagagggtgga

SEQ ID NO: 2935 - DNA, 201 bp, Homo sapiens; identical to SEQ ID NO: 2824

SEQ ID NO: 2936 - DNA, 201 bp, Homo sapiens
caagaaagatagctaatgttagccatctgagaacttgatgacttcagtgaaaaaaaataagacactaggcatcttattaccaatcccaccaaatcaccacygaattatgagaaagttgagtttaccaacaatgtcagatggcatagtcattttaattccactaatgctgagaacaaaaataaagacctagcaataaaatga

SEQ ID NO: 2937 - DNA, 201 bp, Homo sapiens
ttatgtagatatacaaagggccaaaaagtagccaagaaaaattttaaaaatgtatgactttctctacatggtagaccatatacaggcagtatttcagagaygtagggaaaatattcttttaataaacggtgctgaaataatctggcataatatgcaatataaataaataaataaatgaacctggactcccaacttacactg

SEQ ID NO: 2938 - DNA, 201 bp, Homo sapiens
tttttaagagatagggtctcactacgtagacttgaacttctggcctcaagccatcattctactttggcctcctgtgtagctgggattacaggcactcaccrgctcttgcaggcacatttttttaaagtagaaaaagcttttttttttttttttttttgcctcccccaccctttgtttaacctatattgataaaggaaaaga

SEQ ID NO: 2939 - DNA, 201 bp, Homo sapiens
gaaaacttctaaaaggtacttttattactttatttcaaagagattaaattgttttatttgtgcttttaatgaaccccaaaactgcaggaacagagggtcayatgacagagaaaaattcttaagttttactattgtatctattaaggtgttaatacaatacgatttatggagttttcaaaatgtgcccttagaaatatcatt

SEQ ID NO: 2940 - DNA, 201 bp, Homo sapiens
taacagtttataacttacattcttcctttttttagtgtaaattcatttctgctccaccattttctaccatgaaatcactctgaagagattattggtgatartatatcaattgtcaaatccaatattttttggtcaatattctactttacatctttgtatatttaaattactttcaccttgaaaatctcctaccttatcttc

SEQ ID NO: 2941 - DNA, 201 bp, Homo sapiens
ttaaaaaaaaaagggggctgggcatggtggctcacatctgtaatcccagcagtttgggaggccaagacaggaggttcactgaggcccaaagtttgagaccrgcatgtctacgaaattttttttttttaattagctagatgtagtggtacatgcgtgtagtcccagctacttgggaggctgagtggaaggatcccttgagca

SEQ ID NO: 2942 - DNA, 201 bp, Homo sapiens
atgtaatcaattttttaaaccattcaaaactgctatttattcagcaaaagaaaggaattaaaaattaatttcttaaaaattatttcagtgaactttcactrtttgcttgatagaaggaaataagttctggctactagatattcattcagatattgttgactttttttattttcagcaaatgacatgattaaaaatgggttg

SEQ ID NO: 2943 - DNA, 201 bp, Homo sapiens
ggtaaacagaccatatagtgtaagatgaaaacaaccaacacaattttttttaaaggggaggcaagagggaaaggcataacaaaataatagaattccaggaygtatgtaatataataacaagtatgaaaggtttaattcaattagaggttggatcacaaagcaaaactcaactcttatgttgtatatgagaggcacatctaa

SEQ ID NO: 2944 - DNA, 201 bp, Homo sapiens
cagccttgaacttctgggctcaagcaagcctccctcctcagccttccaagtagatggaactacaggtttgtgccaccaggtttagctaatttaaaaaaaawtttttttggtagatatgggctcttgctatgttgcccaggctggtctcaaactcctgatctcaagtgatcctcctgcctcggccttctaaagtgctgagat

SEQ ID NO: 2945 - DNA, 201 bp, Homo sapiens
tagactgtcttatatcaaccatctcactgttgaagaaataaaaaaagttacctaaatcctaaatatggactagaattgaccactaaaacaaacaaaaaaamccagtaaaatcaggaaacgcccacaaactgcatttgcctcagtttagaagcgcttccagactcttaagaatacatcaaatatcttgtttgaccaaaccaa

SEQ ID NO: 2946 - DNA, 201 bp, Homo sapiens
accaaagagggagaggtctaactgtcggtataggatgggtgcagctggggctctgtagaggaggccacatatatgataagacaaggaagagtttgttaggkaaacaataaaaaatagattattctacatatattacatttgtcgtatgctcaaattcatatggcaactcacacataggctgaccaagtatctattttcaca

SEQ ID NO: 2947 - DNA, 201 bp, Homo sapiens; identical to SEQ ID NO: 2825

SEQ ID NO: 2948 - DNA, 201 bp, Homo sapiens
tacatttttggttatcgaaactacaggagtattactgtcacttagcagttagaagtcagagatatgactgaacatcctacgctgtacaggacagtccctgrcaacaaagaaccatctagacaaaaaagtcaatagtgctgacattgtaataaccctgctccacattgcatggtattaaaagagaatcgaggaccttgtaga

SEQ ID NO: 2949 - DNA, 201 bp, Homo sapiens; identical to SEQ ID NO: 2702

SEQ ID NO: 2950 - DNA, 201 bp, Homo sapiens
gacagtatataatacatataacataaaaactatgtacctaatgactgtattatcagtaaggcttccagtcaatagcaggctattagttaagtttctggggyggggagggtcaaaagttttcatgggttttcagctgtacaagggacagcaccccaacctctgtgttgttcaaggtcaactgtacttagaaactttttagaa

SEQ ID NO: 2951 - DNA, 201 bp, Homo sapiens
cttaattgtactgatactagagcatactaggtcaagttaaattttaaaacaacacttacatatttttaaattagcattagcctttatataacctcttcacrtattaaatgagattgtaaaagttaggagtcaaagatagcacctggcatagagcaggcaatgtaaatgtcaagaccctccagaagcactaatgcaaaaatt

SEQ ID NO: 2952 - DNA, 201 bp, Homo sapiens
actaggtcaagttaaattttaaaacaacacttacatatttttaaattagcattagcctttatataacctcttcacgtattaaatgagattgtaaaagttargagtcaaagatagcacctggcatagagcaggcaatgtaaatgtcaagaccctccagaagcactaatgcaaaaattctacaattagcagccctgtgccaat

SEQ ID NO: 2953 - DNA, 201 bp, Homo sapiens
aataaaggacatggctctatttcttctaatttctttcccttttctttcctttctttccttatctctttctcttttttaaattctgaaatccatgtctttargaaatttatggaaaaaaacaaaaagatatgcctatattaagatagttagcaaaattaactataatattctatcatttacattttttcccacgaaactctc

SEQ ID NO: 2954 - DNA, 201 bp, Homo sapiens
cttgacactttgtcaccttatatattctcttctcaggattttctccagtagttcccaccttccccagattcctcatcattattctcaaggcttagattctsgccaattgcttttcacgttctcctctttgactttctgtatcagcactaatgtttgccaaaggtatgccttatctctcagcagctaccatactcatactcc

SEQ ID NO: 2955 - DNA, 201 bp, Homo sapiens
gcaagccagagagagatgcctcatgagaaaccaacccactggcaccctgatctttgacttctagcctctacaactctgagaaataaatttctactgtgtcrgctacgcattctatggtattttgttatagcagcctgagcagactgatacaggtaaggagtttcttcctggggtaatgagtatgttctcaagttagacagt

SEQ ID NO: 2956 - DNA, 201 bp, Homo sapiens
gcaacatggctcctctttcctttatcacttgggaactgtcagagaaggtctagtggagagtaagtacgttcaccaatgcctagtgtaacaaggtcacacamccttgggtgtcagtggtggccatgtgaggaacagtaaggagcactactacccttcccagctaaatagtgtgggctgtggtccagtagaagtgggaaccct

SEQ ID NO: 2957 - DNA, 201 bp, Homo sapiens
gggaggtagggagggatggattaaaggcattttgattggaaaggaagaaataaaactgtctttactcacagaaaaaattatcctgtatacagaaaattctyaggaacccacaaaaaactactagaaatactaaacaagttcagcaaggttgaaggatacaagtataatatccaaaaatcaactgtatctctatatactagc

SEQ ID NO: 2958 - DNA, 201 bp, Homo sapiens
gtaagcatgaattcagctaactatcttttctttctccaataaacatcccatctgggtttcatctgactgctttaattcttcacatacggatggaagggaasaagattggggttatagcatgacagcatagtcaggtaaaggattcaggatgcagttcataaaactaaagagtaaggcccaggcctccaataactacctaat

SEQ ID NO: 2959 - DNA, 201 bp, Homo sapiens; identical to SEQ ID NO: 2076

SEQ ID NO: 2960 - DNA, 201 bp, Homo sapiens; identical to SEQ ID NO: 2826

SEQ ID NO: 2961 - DNA, 201 bp, Homo sapiens
actgtgccctgcctaaaaaaaaaaaaaaaaaaaaaaagctaggaagatctcaaagtgaaatcctaacatcacaactaaaagaactagagaaccaccaccamcaacaacaaaaaacccaaagctagcagaagacaagaaataaccaagatcagagcagaagtgaaggaaacagagacacaaaaaacccttcaaaaaattaac

SEQ ID NO: 2962 - DNA, 201 bp, Homo sapiens
gtaggttaaatgatacgcacaacataatcattagttagttaaatgaacaaccaaaggattattcacactaagacatctcccaccgttacctccactatcamcagtggtacacaaaagacaataacaagtcgagtctccagtactcagaaaggttatattatttcactgaccacgaagagatcagaactttcctagagaaca

SEQ ID NO: 2963 - DNA, 201 bp, Homo sapiens
actcaaggactgactactatgttcattaatgtattttgctttgtatttttcacattctttaatgtatcctggatgtaaaagttgtcaagctactacatctrccaatccgctgattatcagagttgattttgctaaaacaggttccctcagtattccaaaggtattccggacattgtgttaaagaagataatcttttgtaag

SEQ ID NO: 2964 - DNA, 201 bp, Homo sapiens
caaacatggaacagattaaccaaatgtgtgcccacgtgtatgtaagtgtgaggttttttttgccaaatcccagtaacactattgatttcttcccttacatrtagataagatccttgagcaaggcccatactgtatttgatgtgacatcaacacttgtgttatattacaaagattttacttcatatccacaagtcctcagca

SEQ ID NO: 2965 - DNA, 201 bp, Homo sapiens
tatatgtaagactactaaaaaacggtgaaaattacaatttttaccttacaggagcagagatgtacatgaattacgaatttaaggtttattttctaggaaawaaatgaattgtcacttatatatagtccctgatttattttttctgtagattattaaatctctagaagaaatgttttcttacccataatataggtaacattc

SEQ ID NO: 2966 - DNA, 201 bp, Homo sapiens
aaagcccacagttaacatcatactcaatggttaaagactgaaagcttttcctctaacatcatgaacaagacaagaatgcccacattagcctcacctattargcatagtaatggaagcccaagcctgagaactaaacaagaaaaatacgtaaagcatctgaattggaaaggaagaagtaaaattatctcgcaaatgctatga

SEQ ID NO: 2967 - DNA, 201 bp, Homo sapiens; identical to SEQ ID NO: 2827

SEQ ID NO: 2968 - DNA, 201 bp, Homo sapiens
agatagcaagaccaatccctactcttcctcctcctcctcagcctacccatcatgaagacaatgaggatgaaggccttgatgacgatccacttctacttagygatagtaaatatattttctgtgccttatgattttcttaagaacattttctttcctctatatcactttaagaatatggtatataatacatttaacatacga

SEQ ID NO: 2969 - DNA, 201 bp, Homo sapiens; identical to SEQ ID NO: 2703

SEQ ID NO: 2970 - DNA, 201 bp, Homo sapiens; identical to SEQ ID NO: 2828

SEQ ID NO: 2971 - DNA, 201 bp, Homo sapiens; identical to SEQ ID NO: 2829

SEQ ID NO: 2972 - DNA, 201 bp, Homo sapiens
ttggaacaaatgatccctaaaaactctttccatttgaaatactcaagtctatgagaaataaagtgagctgatgatggtttctcaattctaattaattctgycatgtaccagaaacttagaaaaaacatgaagtcaatgacattttgaaacaaaaatgtttgcttttgttgacattcaatgacattttgttgattcttttta

SEQ ID NO: 2973 - DNA, 201 bp, Homo sapiens
aatataaatcgtttctcattcttatagttgcttttattatttttattcttaaagtttttaagtttcttggaatcaccctcccatacatgtatagtacaatyactacctttctgaaattaaaaaaatttatgcacaaacatctccccaaaattcctacatgacagaacaatacctgcttaaaaaaatttgtcactgtgagag

SEQ ID NO: 2974 - DNA, 201 bp, Homo sapiens
aaaggttaaaaatacctattactccaagaaagatacacaaatagccaatacacacaaaatgatgcttaatatcgctagcttttaagaaaaggtaaatccarcctacaatgagtaccacttcacttgcactagaatgactacaatcaaagagcagataatatgttacactggtaaagatatgctgaaactggaaccttcaca

SEQ ID NO: 2975 - DNA, 201 bp, Homo sapiens
gatcgtgccactgcactccagtctgaattacagagtgagaccccatctcataaacaaaaattttaaaagacaacaaacatgcttttacttcctactatttygagggaaaagtaaaaataaaagtgaacactaaacagccattaaagaactgaaactaccagaggagataacagccacatgactcccgaaaggttcatgatt

SEQ ID NO: 2976 - DNA, 201 bp, Homo sapiens
tcccaacagcagtagaaatggggaaagagggcagcattgcatattacctcaagcttctctcttaccctaacatgaacctcagcgtgtcctaaacctcggtrctggtacactaaacatttagcagaaaagtcagaggaagtaactgatcctatcaacatggtttaagaaggtaagcatgaattcagctaactatcttttctt

SEQ ID NO: 2977 - DNA, 201 bp, Homo sapiens
taggattttagtctaggttaaccagactccaaagcccatactcttcactattatacaatgttctaatactcggctgacaaatatactaactaaaaatgagraagaagtagaggggatgttgagaggaaagacataggaaagctgaacatacacaactgttgaagtcatgatctcaactacctcaccaatcttccttctata

SEQ ID NO: 2978 - DNA, 201 bp, Homo sapiens
tcctccagaagaggatgttacattaaaactggatacatccttaagagaaaacaacgtgctgccttatttggcacggtatcttctcacttggtatgagtgcrttactcaattcccatttaagttctgtaacatgtctggattatctatattggctctttttccattaattcacagaaaagataccctagaatccatttatat

SEQ ID NO: 2979 - DNA, 201 bp, Homo sapiens
attaggcaaagtaagagattaataaccctaactcataataaaacagagcaattataacaatatactataataaatgttacatgaatgtggtctctttctcyctgttcctctctccaaatatcttaatattttcacatcgtggttgactacaggtaactgaaactacggaaagagaaacaataggtaagtggggactactgc

SEQ ID NO: 2980 - DNA, 201 bp, Homo sapiens
tttttaaagaataccacagcatatgaaacatatgacacaggctaggtgacaaattaaataaagaagaaaggaagataggaagtgggcaaacagaaaaaaayatagtactagtaaaattccttaatatgctttgttgcatattaaagctattaattgctattgcatataaaatgctattgggagaatagtattctcccaagt

SEQ ID NO: 2981 - DNA, 201 bp, Homo sapiens
cttatatttttgcatatatatatatttttaatccaccacattaaaaagaatacaatattacttttggaataagtttatagataaagtaattcagccttgtmtatctgtctcttgacttctggagtaataacaggaatactgtcgttaatcagagcagctgattagataaatggctcaatgtcaaggttatagctataattc

SEQ ID NO: 2982 - DNA, 201 bp, Homo sapiens
ttagaatgtttcaaccctaatcaacccccaatttatacattgtgttattgattttgttctatcttaattattttaacctcataaactagactctattaccrcaaacacaggtttatctttatgtttttcaatttctttgttcatcattcttctacctaaaatctttcttcctgaagtaattcctttagaagttacattttt

SEQ ID NO: 2983 - DNA, 201 bp, Homo sapiens
gagatcaaattgaggaaggccactggtagcttcaaaggttaccaggctgtaatgtctgatttcttaaactgagcagtggatatgctgctgtttattttatyattacattttgtacatgcactttattgtattattttataggtagaatgtcaccaaaagtgcaattgataaaaaaaatttgctacactggaattcattaaa

SEQ ID NO: 2984 - DNA, 201 bp, Homo sapiens
tcagtgcaattctaatcaaaatcccagtcaggttttcctggaactttgaccaatgatttttaaatttaatgggggaaaagcagagagccaagatactcttraagaagaacaaggtgggatgtggggagcagggagatgaatgtgttctgccagatatctgcagttactaaaaaactaaaataattaggacaatttgatttt

SEQ ID NO: 2985 - DNA, 201 bp, Homo sapiens
aaaattcaatgggaaaagaatagcctttttaataaatggtgctgaaacaactggatatccacataaaaagaatgaaattggactacctcacaacatacaartattaactcaaaatggattattataaacctaaatgtaacagctgaaactataaaactcttacaagaatacatacaagtaaattttgattcatattacata

SEQ ID NO: 2986 - DNA, 201 bp, Homo sapiens
aataaaaaataacagttctcaaagtctggtctgagaatcagcagcacaaacattatctgaaaactgttagacatgtaaatactcaagccccaacctagatyggctgtcacaaaaactcgggaaataaggtccaacaatcagtgttacaacaaaccctctaggtaatttcgattcatgctaaagtgaaaaatgtattttatc

SEQ ID NO: 2987 - DNA, 201 bp, Homo sapiens
gctcagttcttgttatgaatcttgggaaaatagcaaaacattttctgggtttgggttgcttacccagtattcctcaagcatacttctcccagaagttccartattaaatcttgtgttcaaagatccaaagatcacttgtattcttgtagctaacccatagtatctgaaatttgttatcaattatccaactttttttttgct

SEQ ID NO: 2988 - DNA, 201 bp, Homo sapiens
cagtccaataatgagagttaagatatagtcaatttgcatctgtcaatctcaaaagttagggtaatctatatttccttagggatctagtagagatcttctcyagcctttccagaaaatgtaagatatactttactagagtagtggtgttctttaaagaaatatgttgtgatctttgaatggaaaaaaaagtatcacatgact

SEQ ID NO: 2989 - DNA, 201 bp, Homo sapiens
ggtgcacactaccatgcccagctaattttaaaaattttatagagacagggtctggctgtgttgcccaggctggtctcaaactcctggcctcaagtgtttcmtctgcctcggcctctcaaaatgttgggattacaggcatgtaatctatcacatccagccaaaaaaagtttaattaaatttttccaagactcaataattttg

SEQ ID NO: 2990 - DNA, 201 bp, Homo sapiens
gaggagggagagtcatatttcttactctactgtctttattcattaatctaataagtatatattgagtgtctatgatgtgccaagtactgttctaaatactkgtagacagcaatgagcaagacagacaaagttcctaccctcatagtgtttatactctatagagaataaataagcaaaaaacattttaaatacaaagtcaat

SEQ ID NO: 2991 - DNA, 201 bp, Homo sapiens; identical to SEQ ID NO: 2830

SEQ ID NO: 2992 - DNA, 201 bp, Homo sapiens
ttacatatgcatgaatagatatgtgaacatgtcagacaattccatcaacacaactggtaaaacaactcaaagtttattatttatataaagagattaattgrcatcatccttaattagaagggcatattagcaggtatttctgtttctttttgcaacatttcaagcaggctcttttattttaagggtatgtacaagtgtaat

SEQ ID NO: 2993 - DNA, 201 bp, Homo sapiens; identical to SEQ ID NO: 2831

SEQ ID NO: 2994 - DNA, 201 bp, Homo sapiens
cctacatcccaggctgcctgtggcacctggactgcccctcctggatcccccacatcccagggcagcagtgaaagaagggcaggccaggccaagcatgaggmgtaaacagtctttattggactcagaccaggagtccatggctcttgaggacctctatgtatttgtcagttttcttctccatgttcttttggcctgtttcta

SEQ ID NO: 2995 - DNA, 201 bp, Homo sapiens; identical to SEQ ID NO: 2705

SEQ ID NO: 2996 - DNA, 201 bp, Homo sapiens
ttttttgttgttttgttttatatttttttacatacttcttttttggaagaaaaagtttcagtgatttcagctttatagaggctgaagacgaaggtgaagamgacggtcccaagtgctgaaatgcctgagttttaattacagtcctgctacctacaagctgtgcattctaagacaagttacttaacttctctgtgccttagt

SEQ ID NO: 2997 - DNA, 201 bp, Homo sapiens; identical to SEQ ID NO: 1658

SEQ ID NO: 2998 - DNA, 201 bp, Homo sapiens; identical to SEQ ID NO: 2677

SEQ ID NO: 2999 - DNA, 201 bp, Homo sapiens; identical to SEQ ID NO: 1659

SEQ ID NO: 3000 - DNA, 201 bp, Homo sapiens
ggtggggcccctgggaggtaatcaggtcatgagggtatagtcaccatgacaggcttggtgtccttatgagaagatgaagagagccagccctccctctggcrtgtgaagatacaaggagaggatggccatgtacaaacgaggaagagggccctcacctggatgtgcccatgctcgcaccctcatctcagacttccaggctcc

SEQ ID NO: 3001 - DNA, 201 bp, Homo sapiens
agggttcatcactttgtctcctgccagggcctcccctcccctggggtcctgacgagggtgacttgcccagtggatgttggtgatgccagatgtctccaccytaaactgacaccggaggagggcccagtggggaaatgccagggacagcaaaatgtgtggcatggagttcctcttcccaggatccagcgtctccctccacct

SEQ ID NO: 3002 - DNA, 201 bp, Homo sapiens
agtcggagttggaggcattcctacttacggggttggagctgggggctttcccggctttggtgtcggagtcggaggtatccctggagtcgcaggtgtccctrgtgtcggaggtgttcccggagtcggaggtgtcccgggagttggcatttcccgtgagccttagtcacacctggggacatgggttgagaagggatgggggct

SEQ ID NO: 3003 - DNA, 201 bp, Homo sapiens
gctaaggcagctgcaaaggcagccaaatacggtgagtgctatgctgacagctctgccccaccctgtcctggcctttacttgccagaactaaaggaccctcytctacttgcccagagaagggaagtgacttgcccaaggtcaccgagcaagtcaccagcaggcctcaggacaatgtctcccccatttgtctcccaccacagg

SEQ ID NO: 3004 - DNA, 201 bp, Homo sapiens
cactgcctctttttaaatatttttttaattattgttttccgtccttaagtaggaacaggggttttcaacctggctatctattagacttcccacccaagaayccctgcttgctttggttggagagggacctggacacagacttttcaggcttcccaggtgacggtggggtcgccagggccaagaagcactggtttagaggtc

SEQ ID NO: 3005 - DNA, 201 bp, Homo sapiens
gagcttctggacaggccccaggctaacctcagggcccctctctgcctccaggcagggcaaaggtgggcagcgccaggagggtgcggtaggagccagaggcrttggggagaggccagcctgatttatgaggcaagcagggatgggatcacttggcaaggtgggcatgcacgacagaccctcagagataagagcccagaggta

SEQ ID NO: 3006 - DNA, 201 bp, Homo sapiens
tgccatgatcacaccactacaatccagcctgggcaacagagtgagatcctgtctcaaaaaggaaaagaaaacttacttgaatgtgattgctctcctttgcyctcaaattattatactgtactttactaacctattttcagacacagttgaccacagcacactgaaaacgaggaaagagaaatggcagatacaggtgggact

SEQ ID NO: 3007 - DNA, 201 bp, Homo sapiens; identical to SEQ ID NO: 2392

SEQ ID NO: 3008 - DNA, 201 bp, Homo sapiens
atacggaaggagttggagtgatttcacttttctgatcaagaactgatagccattaaaactcagctccgcaatatatccccccactccaagggagggctgaratgatcacttcgttttctgttacggctacttttatatttttcaacattactgctggtctgtaagagaactaaaacatctgattttcctcatttccttgta

SEQ ID NO: 3009 - DNA, 201 bp, Homo sapiens
gtaatttggccacatgttctatctctagaaaggtcaatgttgcacacacactaagtcaatttgaatacagccagaggctagctctgccacagagcagggcycctatgagtcagtcaacaggaaaatcacactaaatgacacacctgcagctcaccattcagggcaggtcattggttagaccttccctggatcctttctagc

SEQ ID NO: 3010 - DNA, 201 bp, Homo sapiens
gtgatcctcccagtgtgctccaccgcaatgcccagccttgcttcccccttgacttgctgctcgcctggcctcacaatgcccaaaagcataggatggggacrgctccccaactgatccttgaaacaatgtgccccagcctactcctgcagcaggggacaaaagtcacccacaatcctgggtatctatagatctaaaacaaaa

SEQ ID NO: 3011 - DNA, 201 bp, Homo sapiens
catctcagtaccaagtggctgttctgattctgaaggcttggttccctcacctgtctaatggagcacagactgcctctgctcctgactgtgaacaacttatyatgcaatgtcgctgctggcacccgagctccttagctacacaagaacctctgtgaagccctgtgtatgcacaactgggggcaaacccagtggtgaatcccc

SEQ ID NO: 3012 - DNA, 201 bp, Homo sapiens; identical to SEQ ID NO: 2409

SEQ ID NO: 3013 - DNA, 201 bp, Homo sapiens; identical to SEQ ID NO: 2413

SEQ ID NO: 3014 - DNA, 201 bp, Homo sapiens
caggtgcaaatcttttggagcttggattaggcaatggtttcttaaatacaataccaaaagcacagcagcaacaacaaaatagacaaagtggacctcatcaraagtaaacactcttgtgcatcaaaggacactattggctgggcatggtggctcacgcctgtaatcctagcaccttgggaggccaaggcaggaggatggctt

SEQ ID NO: 3015 - DNA, 201 bp, Homo sapiens
cgaagtgtctcattcttctgatgcaattccatctgctcccaaaagtggggtgaggcagcgggcaggttagaattatgtcatgcatggattgttctcgtgcrtgacagggaatccaataggcttctacagctctcagaataagctcttccataaacaggaaagcccctgggcctgggagacgctctggtggcattagacaca

SEQ ID NO: 3016 - DNA, 201 bp, Homo sapiens
aagaaacctcagggctcgaagtgtctcattcttctgatgcaattccatctgctcccaaaagtggggtgaggcagcgggcaggttagaattatgtcatgcayggattgttctcgtgcgtgacagggaatccaataggcttctacagctctcagaataagctcttccataaacaggaaagcccctgggcctgggagacgctct

SEQ ID NO: 3017 - DNA, 201 bp, Homo sapiens
acttccgaggttcgtggactagagagaatcagcactggactaaatactggatgtaggaaagctggctagggtggggggaaaagcctgctggaaagcagtgrgaattctcctaattaagtagttagggcctagctgcggaaggccttaacctttttatgcctagtattccattactggaacgctaagggcgtgggagttact

SEQ ID NO: 3018 - DNA, 201 bp, Homo sapiens
agagataaaggtgctatattcacacctgctatccctccccttatcaagagataccatcctatcacactgtatcctgcatttggtcacagcaagctgtcagycaacaactagtgatgggcccctttagggacaaggtcttgtggtatcaccttacttccttacttcactgacttaggagccaacttatgtggttttaagcca

SEQ ID NO: 3019 - DNA, 201 bp, Homo sapiens
tcttgaaagctgccctggctccctacatatccaccctacactggatcaggcaaagacaagatgaaaacaagaggcttggagtctacagacttttggtgatrataacgtgttcacgcatgttgaccactctagtggggatgctgacaatgggggggctgcgcatgtgcagaggcagtgggtactcatgggtttatgtacctc

SEQ ID NO: 3020 - DNA, 201 bp, Homo sapiens
taaaatgtagattctgacccaggcaaatatgcatccctcacaagctcgcattggtgccctgtggattactccagcagcactgcccaagagaaatccaatgygagccacacagggcattgaagacgttctggtactttttttttcttttgagacagaatctcgctctatcccccaggctagagtgtatggcgtgatcttggc

SEQ ID NO: 3021 - DNA, 201 bp, Homo sapiens
taagttaggcaggagaatgactttgttactgtcattatctggagattaagtatagtttaaggaaatgcatatgggtgtagagctgacaaggggggaaccaygatggctttgatatatcaacttgacgattccccagttattcaatcaaatactaatctaggtattactgtgaagctattttgcagcggtaattaaagctac

SEQ ID NO: 3022 - DNA, 201 bp, Homo sapiens; identical to SEQ ID NO: 2426

SEQ ID NO: 3023 - DNA, 201 bp, Homo sapiens
gacactgctgcctgcactgcggctgctatcggggagcaggtgctgggaacctgctgcttaggggacagctagtgtggctgcatctacaggccctagtatgkaacacattgctaagaagcaggctcctagcacagccccgtggactgtgttggtggcattcagaggccaccttcctgcctcggctgcattcactaaaatgaa

SEQ ID NO: 3024 - DNA, 201 bp, Homo sapiens
tgcctagaggctggtctcaaactcttgggtttaagtgatcctcctgcctcagcctcttgattagctgggactacaggtgtgcgctactgcaaccagttcaygccaggtctattttgataactgcaaattcatcatcaccaggagaaacacttgtgactatgtcaggtaatgctcacagcctagcaaggaaagtactgctgt

SEQ ID NO: 3025 - DNA, 201 bp, Homo sapiens
tacagttacagtaagcagctgagatcagctgtcccaaggcacaggccttaaatagagcagaagcggggtccaagagaaagcccagtggaggcagcccgggrtggcaggatcctcccgccaggctgtgccgttgagagctcaggctcagggtctgctgtccatggctaagctgccctgccagcaggacagacggacagacac

SEQ ID NO: 3026 - DNA, 201 bp, Homo sapiens
gtggttaaacacacagactctggagtcagatttcctggtctgaattcttgccccaccatttgctgtgtgctctcgggcagattattcagccagccatcagyttcctctcctgtagaaaggtggtcacagtctctatcctgtgcacacacacagcctaaaatgaatattcccagctcacaggaagcatgatacatctcagta

SEQ ID NO: 3027 - DNA, 201 bp, Homo sapiens
tagggaggggacatcaagatgcagagatctcatttgtcttttcattctggcagtttggctcagaatgaccaaatgttcatagaaatatgaaccctgtaacsacggcatttaaaactccaaatattttaatccttgaacatatatgggatgcattgtgttggactaacttcagatctgggtaactaaagatttctctaattg

SEQ ID NO: 3028 - DNA, 201 bp, Homo sapiens
cagatcaggcccgatttttggtggccagccggggagccgctcttgcccaacttgggcgaggtcgcctggaggacttgccaatgatctaacggctctgctgyaggttcctcaagaggtgccttctcggagttaaatgagtcaccgcttactaggcagaagcgcgggccgcgagcgcgggcgagaggcgggggctaccggtgg

SEQ ID NO: 3029 - DNA, 201 bp, Homo sapiens
aggaccaagaataccctaacaggatgtgcaatccaatttttacgttcttacatttccaacctcacctattacacaagcaatgaaaagcccatacatggtcytgttactatgaataccatcttaactttcccctttatgcatccaacgcaacctgttatcaggcctgcccctggggcacctactaccccatcagtgtaatta

SEQ ID NO: 3030 - DNA, 201 bp, Homo sapiens
ctactctggaggtcaaggtgagaggatcacccaagccagggagattagggctgcagtaagccatgattgtgccactgcactccaccctgggtgacagaccragactcttgcctaaaaacaaacaaacaaaaaaattaaggacatttttgccggcagacctgcttttcaaaaaatgtttaaagtatttttttgtttttgttt

SEQ ID NO: 3031 - DNA, 201 bp, Homo sapiens
tcaggagactgaggcaggagaatcacttgaacctgggaggcagaggtaatgagacaagattgagccactgcactctagcctgggtgacacagcaagacaaygtttcaaaaaatatttttttaattaaaaaattagctgggtgtaagggcacatgcctatagtcccagctacttgggaggctgaggtgggaggatctgcctg

SEQ ID NO: 3032 - DNA, 201 bp, Homo sapiens
catgaaaagatgttcaacatcattagccattcgagaaatgtaaatcaaacccacaatgagataccccttcacaaccattaggatggaatttaaaaacacaraaaacggctgggcgcagtggctcatgcctgtaatcccagcactttgggaggccaaggcaggcggatcacctgaggtcaggagttcaagaacagcctggcc

SEQ ID NO: 3033 - DNA, 201 bp, Homo sapiens
cacgcctttctctcaggtcaccacagctccaaccgagaggactctcccatagtctgggcaggggcacagggtgatgccctccttccccattctctttccarttctctcagcgtcacgtagactccgctgcttccctaggctttccctgttgagttgtgagaaaagcagatattgcttcttgacccttacattctattattc

SEQ ID NO: 3034 - DNA, 201 bp, Homo sapiens
gttgcagtgagctatgactgttccactgtactccagcctgggtgacaaagcaagaacctggctcaaaaaaataaataaataaaagtaaataaaaagttatwtaaggcactatcaagaaagtgaaaagacaacctacagaatgggagaaaatgtttgtaaatcatgtaactatcagttctatcagaattctacaactcaaca

SEQ ID NO: 3035 - DNA, 201 bp, Homo sapiens; identical to SEQ ID NO: 1438

SEQ ID NO: 3036 - DNA, 201 bp, Homo sapiens
tccccaaatatcacggagtacatgttctgtgccggctactcggatggcagcaaggactcctgcaagggggacagtggaggcccacatgccacccactaccrgggcacgtggtacctgacgggcatcgtcagctggggccagggctgcgcaaccgtgggccactttggggtgtacaccagggtctcccagtacatcgagtgg

SEQ ID NO: 3037 - DNA, 201 bp, Homo sapiens
ttgccccagaaggagactgcagcccctgcagacctagaaatggccacagcccatccccatgcaccagggggtgaggtggcaggtggtggaaagggcctgargggggcttcttccttccaggcgagcacgacctcagcgagcacgacggggatgagcagagccggcgggtggcgcaggtcatcatccccagcacgtacgtcc

SEQ ID NO: 3038 - DNA, 201 bp, Homo sapiens
ccccagacaaggatgaccagctgatctgtgtgaacgagaacggcggctgtgagcagtactgcagtgaccacacgggcaccaagcgctcctgtcggtgccaygaggggtactctctgctggcagacggggtgtcctgcacacccacaggtgaccaggcttcatgtcccagtcccagatgacaccagtccctgtcccactacg

SEQ ID NO: 3039 - DNA, 201 bp, Homo sapiens
tgcagcagccattttcttctctaagcagaagagagcccagcaagctggaggaggctgaagagagaggcttcctgctggtcatctgggtccagaatgcctgsagatctctgctcagccctggtgcccagcagccctggtgtgcatcctgcagggcaggccttcccgccggagtcctggacttgctcagggccactccccttg

SEQ ID NO: 3040 - DNA, 201 bp, Homo sapiens
cgcacacacagatatgcacacacatggatgagcacacacacaccaatgcgcacacacaccgatgtacacacacagatgcacacacagatgcacacacaccratgctgactccatgtgtgctgtcctctgaaggcggttgtttagctctcacttttctggttcttatccattatcatcttcacttcagacaattcagaagca

SEQ ID NO: 3041 - DNA, 201 bp, Homo sapiens; identical to SEQ ID NO: 3036

SEQ ID NO: 3042 - DNA, 201 bp, Homo sapiens
ctgtggctcacctaagaaaccagcctcccttgcaggcaacggcctagctggcctggtctggaggctctcttcaaatatttacatccacacccaagatacaktcttgagatttgactcgcatgattgctatgggacaagttttcatctgcagtttaaatctgtttcccaacttacattaggggtttggaattctagatcgta

SEQ ID NO: 3043 - DNA, 201 bp, Homo sapiens; identical to SEQ ID NO: 3037

SEQ ID NO: 3044 - DNA, 201 bp, Homo sapiens; identical to SEQ ID NO: 3038

SEQ ID NO: 3045 - DNA, 201 bp, Homo sapiens
tcacctgacctttctcctgtcccccccacttgagctcagtggctgggcagcaggggatgcatggccactggccggccaggtgcagctctcagctggggtgytcagaggacgcctgtgtcctcccctcccccatccctctgtcacccttggaggcagagaactttgcccgtcagtcccatggggaatgtcaacaggcagggg

SEQ ID NO: 3046 - DNA, 201 bp, Homo sapiens; identical to SEQ ID NO: 3039

SEQ ID NO: 3047 - DNA, 201 bp, Homo sapiens; identical to SEQ ID NO: 3040

SEQ ID NO: 3048 - DNA, 201 bp, Homo sapiens
caggagggagaaaccatcatgctgaggtgccacagctggaaggacaagcctctggtcaaggtcacattcttccagaatggaaaatcccagaaattctcccrtttggatcccaccttctccatcccacaagcaaaccacagtcacagtggtgattaccactgcacaggaaacataggctacacgctgttctcatccaagcct

SEQ ID NO: 3049 - DNA, 201 bp, Homo sapiens
caggaaggggccaccaccagaggggccattttgcggtggaaatgtccttttccaactacccatgactcagcttctcccggcttggcaccatgccacagccmccacacctctgcggggaggggacacaagaggacctccataaacccacttctttgatttaccagagaataatctaggaaaagcatcacccggaggagaaat

SEQ ID NO: 3050 - DNA, 201 bp, Homo sapiens; identical to SEQ ID NO: 2208

SEQ ID NO: 3051 - DNA, 201 bp, Homo sapiens
agagtttccctattcggctgtcctgcctgggccctgagatcagttcagccttgtctttctgtactttatctgcaatcaataaatggagaaaatatgtgtgygggggtgggctccacctcaaatcaaagaaatcactgcaccaacagctcagagcttccgcccacccgggtcggctcaatgaggttgcctcaatgatctgac

SEQ ID NO: 3052 - DNA, 201 bp, Homo sapiens; identical to SEQ ID NO: 2209

SEQ ID NO: 3053 - DNA, 201 bp, Homo sapiens
gagatcagttcagccttgtctttctgtactttatctgcaatcaataaatggagaaaatatgtgtgcgggggtgggctccacctcaaatcaaagaaatcacwgcaccaacagctcagagcttccgcccacccgggtcggctcaatgaggttgcctcaatgatctgactataggaaacatccctgcagtgcagccccctctcc

SEQ ID NO: 3054 - DNA, 201 bp, Homo sapiens; identical to SEQ ID NO: 2210

SEQ ID NO: 3055 - DNA, 201 bp, Homo sapiens
ctttgactatgagtgaggttgaatatcttttcacatacttattggctatttgtatttcttgtaatctgttcacatcctctgcctgtatggtggttactttrtgagtccaggtgtctgaaccattgtctattgtcctagggaagttaatagagtgatagaaccccatgaatttcaccttttcacaagtaggagcctcaatca

SEQ ID NO: 3056 - DNA, 201 bp, Homo sapiens
tttaagtaatggaaaactaacttcaaacagcctgtatgtccaacactcaggaattgctcagaaaatcctttgaatttattatcacggagtgcttaatgatyacgaatataaagacaaggtgatgacagaaaaatgctaataatacaatgatttaacttttgatgaaactaatacatttacactatttacctataaatatat

SEQ ID NO: 3057 - DNA, 201 bp, Homo sapiens; identical to SEQ ID NO: 2211

SEQ ID NO: 3058 - DNA, 201 bp, Homo sapiens; identical to SEQ ID NO: 2212

SEQ ID NO: 3059 - DNA, 201 bp, Homo sapiens; identical to SEQ ID NO: 2213

SEQ ID NO: 3060 - DNA, 201 bp, Homo sapiens
ctttggaaatgattctgccagaacaggaactgagaattttttctctgtgacctctgggtgagtttgtgttccatgagaacattgggctttgcatttctcaktacactgctctcatagctcttgggtttggaagaggtcactgtcatcaaactttttatgactttagccctcagagaaccaaggataaaggtgaataaagaa

SEQ ID NO: 3061 - DNA, 201 bp, Homo sapiens
ttaaatattagatcaaagtgaaagtcctttgtaactgaaattgggctatttgtaattgatcccccaaggcttctttaaatactgtcatctctgattattcktatctgattaagatatggagaggaggcactgagggctgccctgatttgagattcacaggggaatggccctaagtctttgaggaagacagtgaggggacca

SEQ ID NO: 3062 - DNA, 201 bp, Homo sapiens; identical to SEQ ID NO: 2717

SEQ ID NO: 3063 - DNA, 201 bp, Homo sapiens; identical to SEQ ID NO: 2718

SEQ ID NO: 3064 - DNA, 201 bp, Homo sapiens
atcactgcaccaacagctcagagcttccgcccacccgggtcggctcaatgaggttgcctcaatgatctgactataggaaacatccctgcagtgcagccccmtctccacgatcccctaatgtcccagaacccctcagactacagtcccctaaccgcagtgttcccgaatgtcatcatcattcagaagccgcaggctgcaaat

SEQ ID NO: 3065 - DNA, 201 bp, Homo sapiens; identical to SEQ ID NO: 2214

SEQ ID NO: 3066 - DNA, 201 bp, Homo sapiens; identical to SEQ ID NO: 2215

SEQ ID NO: 3067 - DNA, 201 bp, Homo sapiens
caaggaagaagtcataaagcacagactgaatcctttctctttgtcatgaggattccaatctagcagggacaaagctctagtctttccttgacaaataagakaattcagagattaagggattggaaaaaatgagaagccagcctagctttccagcaaagggtaaaaactaaaaacagaagatccagggaggcagcggagagt

SEQ ID NO: 3068 - DNA, 201 bp, Homo sapiens; identical to SEQ ID NO: 2216

SEQ ID NO: 3069 - DNA, 201 bp, Homo sapiens; identical to SEQ ID NO: 2217

SEQ ID NO: 3070 - DNA, 201 bp, Homo sapiens
tcattcattttcctccctccccttcagggtgtagagaaaggcctggaggattcacgaggggaaatgaagaataaggtgagttctcttgggtcagggcctgwctgctaaaaagagggcagcagtgtttctctaacacagctctcaaagtcagtggggctccaggattggggacccctggcgccaccctcacccccatcagcg

SEQ ID NO: 3071 - DNA, 201 bp, Homo sapiens
agtgaggagagttttgccaatttcaaaccaaacaatgtagggtgtccgcataacccctgctctgcacttagcgcctcccttccctttccctcggctctttsacttttccatcttgcacactggcaatcgttcttgacctctgcccgcagatcctgtgccggtatcagaatatctggaacatcaacctgcagttgcggccca

SEQ ID NO: 3072 - DNA, 201 bp, Homo sapiens
ctcactgaaacaaatcaagaggtgaatatattgaagtgagttatttttagtgaaggtggaatttgagcattcaaggtatgtactttaattcatttactctrtattttttctatttattcaagtcaattcaataaatatttattgaatagcaaccatgttttagaaatcgtcctaaggaatattctgatttattaaagacaa

SEQ ID NO: 3073 - DNA, 201 bp, Homo sapiens; identical to SEQ ID NO: 1914

SEQ ID NO: 3074 - DNA, 201 bp, Homo sapiens; identical to SEQ ID NO: 1915

SEQ ID NO: 3075 - DNA, 201 bp, Homo sapiens; identical to SEQ ID NO: 1919

SEQ ID NO: 3076 - DNA, 201 bp, Homo sapiens; identical to SEQ ID NO: 1920

SEQ ID NO: 3077 - DNA, 201 bp, Homo sapiens; identical to SEQ ID NO: 1921

SEQ ID NO: 3078 - DNA, 201 bp, Homo sapiens; identical to SEQ ID NO: 1922

SEQ ID NO: 3079 - DNA, 201 bp, Homo sapiens; identical to SEQ ID NO: 1923

SEQ ID NO: 3080 - DNA, 201 bp, Homo sapiens
cagaggaatagaaccttcttaccaaatctggagtgtgattgtaattttacttttgaagcacccgcttcccagaagaactgccagtgatggatgccactgtsaggaacccagatgcgcacgctcatacatcagccgggaaatcatacaaacagctctcccagcaggccagggctgacacacccattactcccctatggaaag

SEQ ID NO: 3081 - DNA, 201 bp, Homo sapiens; identical to SEQ ID NO: 1940

SEQ ID NO: 3082 - DNA, 201 bp, Homo sapiens; identical to SEQ ID NO: 1941

SEQ ID NO: 3083 - DNA, 201 bp, Homo sapiens; identical to SEQ ID NO: 1942

SEQ ID NO: 3084 - DNA, 201 bp, Homo sapiens; identical to SEQ ID NO: 1943

SEQ ID NO: 3085 - DNA, 201 bp, Homo sapiens
cttgcagtgagccgagatcgcgccactgcactccaccctggcagacagcaagactccgtctcaaaaaaaaaaaaaaaaattagccagggccgagcacagtrctctcgcttgaatcccagaactttgggaaactaaggcggggggggggggtcacttgaggtcaggagttcgagaccaccctggccaacgtggtgaaacacc

SEQ ID NO: 3086 - DNA, 201 bp, Homo sapiens
gggcacagaggaggggtaggcgcaggccattccaggccattacccattccagccggatccgggtcttgcggcgcagtcaggctgcaggtggcaaggccccsgtcctggcccacaggctgccattcaatgcaatacgtcatgctctgagcccgggctggccaatacatggtggtcccgttggttccgacgctgatattcaga

SEQ ID NO: 3087 - DNA, 201 bp, Homo sapiens
attacccattccagccggatccgggtcttgcggcgcagtcaggctgcaggtggcaaggcccccgtcctggcccacaggctgccattcaatgcaatacgtcrtgctctgagcccgggctggccaatacatggtggtcccgttggttccgacgctgatattcagagccactggttctggaaggagaggggagagacgcatcga

SEQ ID NO: 3088 - DNA, 201 bp, Homo sapiens
caccacttgcctagcctaggcggagagtgtgatgcaagactaggcctccctggcctgaccggcgccactggtggtctcatgccaaactcagaagcacgagyacacacccactcagtccctgggcaaatctctcccactccctcccgccagggcgtcttcatgaatgtcagagagatggatactgcttgcaattctggggat

SEQ ID NO: 3089 - DNA, 201 bp, Homo sapiens
tcatctccagggggcagaggcaggactctggggagaggcaggtcgaacatcaggccgtaagaattgtccaggacttggcaccagtcacttaaccatcatgygcttattgagctccaactgtgtacagagccacgtgctgggtcctgggggctcagcagaagcaggccaggccctgtcctcttagggcctccaggatcaccc

SEQ ID NO: 3090 - DNA, 201 bp, Homo sapiens
caactcggcctcccaaagcactgggattacaggcgtgagccaccgcacctcgctaaatttttttaaattaaagaccatacttccagggattatttctatcrttaattactagagaaccttctctaggttcaaaccttctttaggaacatataaagcagtaaaaaattattataactaaattttaaaaattaataattattt

SEQ ID NO: 3091 - DNA, 201 bp, Homo sapiens
agccactgtgtccagccaattctttttttgtttgtttgtttgtttagaactatcagggaaatcgtacttagtttttagatctatttcaaggaacctgaccyaaggagagacataaattagcataaaatagtcttgctgcaccgtggtcatacccggcctgattctttttttatatcattgtataaatttaagaggtatgat

SEQ ID NO: 3092 - DNA, 201 bp, Homo sapiens
cctgcctctgccccctggagatgaatgtggcccaggaattccagctccgacgacggcagctggggagccaaggaagttcctggagcaagtggagcagcccygtgtgcgttccccctggtaagatcactctgagtacaggaacaggggcaagcattagaaataaggcaacagccggaggtggtggtgcacacctgtagttcc

SEQ ID NO: 3093 - DNA, 201 bp, Homo sapiens
tgagtgtctcataattttgtgttgaaaggtggacattttgcacattataatacagtaactcaggaaattcagttctccacatccccatggtttgttgttgytgcttgtagtgggttgttgttatctgtctgtttagtgacttttctaaaacatttttctacagtctgtattctttgttatgtgtggtcactgaagtcggtg

SEQ ID NO: 3094 - DNA, 201 bp, Homo sapiens
ccattttctgtttctggatctggcagtagccacaggcagccacaggatccagacgtcttggcagtgagtccagtaacatcaaggggactatgggctcccamgttcttgcagcttctgtaaatgtgcaaattctcagcctcttgaaaggtaacagcagcagtggtttcaatagcagcagcagcagcattaacaaaaggatgc

SEQ ID NO: 3095 - DNA, 201 bp, Homo sapiens
ctgttggcatgcttgatgatgtcctacaggccttttagactctgctcatttttttcccattctttttgctttcttttcctcggactggaccatttcaattracctatcactggttcttgcttctgactgctcaaatctgctactgaatccctctagtgaattttttatttcagttattctacttttcaacctcagaatttc

SEQ ID NO: 3096 - DNA, 201 bp, Homo sapiens
gttcttcttgctgtctttggtttttggacaggattgcagaactggtttagccagattactggcctggatggtgctagctggtgcatcagaattttagggtytgaaaaacatttcaagcactaatcttgggttttacaatagcgatgttatccctaggagcgactggggaggtttggaatcatgtggcccctggctgagtga

SEQ ID NO: 3097 - DNA, 201 bp, Homo sapiens
tatgggctcccaagttcttgcagcttctgtaaatgtgcaaattctcagcctcttgaaaggtaacagcagcagtggtttcaatagcagcagcagcagcattmacaaaaggatgctggcaacctcagcaacatagctcttttgaattctgggtaccatcactggccctttttgcccctccttggattttattctctctgtttg

SEQ ID NO: 3098 - DNA, 201 bp, Homo sapiens
ggaggagagaattagtagatacctgatacaggatataagggctaagctttagatttttctatcctgactcgatccagggtatttggtttctattgtttttmactaaataaagataggtctttcaacaatcccagcttctgtggaattagctgaaaataaaccaagagctagagactcaaagtatttacagtagatacattt

SEQ ID NO: 3099 - DNA, 201 bp, Homo sapiens
attaaaacttctgtttacatttgagcaaaacctgctcttaataattactctcaaaagttgcaagctaaagtaactagataattcaataaatatatagatascaggtctgaggctcagaaggactgtccagggtgggtcaccaagctccaggccaccagactagcgacaagagttaggctgcaattcccaggaaggaagaat

SEQ ID NO: 3100 - DNA, 201 bp, Homo sapiens
attactttgtttaaaggactacaaaccagtgagctttctttctttcagaggcgtattttttaattaaaatcactgatgcagaacaacaatgtgttttccaygtgcacttggtcaacacctatatctttactgtgtctcctatgagcaggtactggacacggaggatgtaaaaaaaaaaaagaaataaaaatgaggcaccat

SEQ ID NO: 3101 - DNA, 201 bp, Homo sapiens
aaaggcagatcaggagagagctgctgaagcacgaaggatgaggggctaagattccatggagagattagctaacagtagttagctactttttaatagttacragagcattggccaaggcagggaatctgtattttaccaaggtaggaggtcactgccaggagacagagaaatcactgttgatcggtgttgtgggaatgaaga

SEQ ID NO: 3102 - DNA, 201 bp, Homo sapiens
tcatcacagtggaaatacagtgttacagtttcattctataaaagttaaatatatgcttaaaatcagtactattcagaggaacattcagattccggaatttytacaacacatcattcacaatattgaggatgcaatccaaaattatgcaacattcaggccggatgcagtgcctcacacctgtaatcccagcactttagaggg

SEQ ID NO: 3103 - DNA, 201 bp, Homo sapiens
agaaattctagaactgaaaaacaaaacagctgaaatataaaattaactgggtaagcttaagaaccaaatggaatgatggaggaaagaaacaatggacttamaagtcaatagaaattatctgatttgaagaaggcagagaaataaattttaattaacagagcctatggatctgtgagacaattcaaaactgaagacctgaaa

SEQ ID NO: 3104 - DNA, 201 bp, Homo sapiens
gaattcctctgagctttgcagcactcatcccggggacactgactcacaacacagtttatatgaaaagaggggatgctcatcatcccctgaagttcaagacsaggctgagaaacatagtgggactctgtctctacaaaaaaaaaattctaaaaattagtcatgcttggtggcacacacctgtagtgccagctactcgggagg

SEQ ID NO: 3105 - DNA, 201 bp, Homo sapiens
gctactttttaatagttacgagagcattggccaaggcagggaatctgtattttaccaaggtaggaggtcactgccaggagacagagaaatcactgttgatyggtgttgtgggaatgaagagacaaaattggaaattggaagggccaggcccccagcaagaagagagggctggagaactgaacctacatataatgagtttcc

SEQ ID NO: 3106 - DNA, 201 bp, Homo sapiens
gcggttcctggaggcatgtcccggacacagctgtggggcccagccagcctacaggtgaccagcctaacccagcccctgtgtctgcagagcccacacgtgtrtccctgagaacaacggaggcgcggggtgcgtgtgccacctgctcatggatgacgtggtcagtgcggataactatacactggacctgtgggctgggcagca

SEQ ID NO: 3107 - DNA, 201 bp, Homo sapiens
gcacaggatgcttcgttacactggtgcccaggacataatcacgtacacaagacacacagttacggggcagactggggatatacggcacaccagcatgcagsgttcaccagtaaaggtggtattccatgattattctaaggtagatgggctgtgctttgtttccattggcttagtccagggattggcaaactatggcccgtg

SEQ ID NO: 3108 - DNA, 201 bp, Homo sapiens
gtagctgggactagagatgcacaccattgcacccaatagagcaatacgtttctgttctttgtaaattacctgctctaaggtatttttgttatagcagcctrtatggactaagctgacttgtaacgttacttgagactttaaagtgttccggtcactgttggagggctctgtctgtgttagctcatttaatccccacaacac

SEQ ID NO: 3109 - DNA, 201 bp, Homo sapiens
gtggtatcctccaagaaatgatctgggacagaaacatattcgctgagctctggtacctcagatggggcaggagtgtcagacagatccatttcatctaggtstctgaccatatcttcgccacctgcacttgatcggctgtcatctgaagatgcaggtggatgtgaaattcccagagccagttggctgattgcagaataatca

SEQ ID NO: 3110 - DNA, 201 bp, Homo sapiens; identical to SEQ ID NO: 1767

SEQ ID NO: 3111 - DNA, 201 bp, Homo sapiens
ccagattgattcatgctcctctcacccctaaactcattttcagtctggttttttaaatggtataaccaaccaaaatgcttacaattgttctcgaggtatgygaccctaccaacatcattatgcccctttggccacttcatgaaatgcttctctgtagtttgttggcataaaacctgcaaaggtaacctttgtgcaaaaaga

SEQ ID NO: 3112 - DNA, 201 bp, Homo sapiens; identical to SEQ ID NO: 2020

SEQ ID NO: 3113 - DNA, 201 bp, Homo sapiens; identical to SEQ ID NO: 2021

SEQ ID NO: 3114 - DNA, 201 bp, Homo sapiens
atgatttttttagagaccttattttgtctttcggtaactgtagctaaagtccaagatataattaggaactttaaaagagtgttcccttcatcctataaccrctttacaaacactcaacaatttcctctggaagataatgaaacacacagagggcatctggtccctaagactaaacctcaaggtcaagcttggttgtagctc

SEQ ID NO: 3115 - DNA, 201 bp, Homo sapiens
caacatcggctgtgcaggtgcatgctcacattcctggcaccaaacatgtcacactccattttctcctctgcagaatcgaatctgaccataacaatggactrggcttgctaagaatgatactagcatgcctctttgttaagactttcagtgggttgaaatccaggtctccaaagagaaagccctaacctgtctacttctgac

SEQ ID NO: 3116 - DNA, 201 bp, Homo sapiens
tttcttccagcctattccatacacctcagaggagagaagcctcatgtatgcttccgcactgattaatttatgcagtctttcactcactcaacacatacttrtcaggccttattatctacttaaacttgatgcaagcctgcaaatcagagagtatctctggtatagaccacataaacctacctacacatctcccaactgagc

SEQ ID NO: 3117 - DNA, 201 bp, Homo sapiens
aaacttgcaaaaactcattaaccctgtaccacacttgtcatatatgagactgtattttaagaaacaaggccttgacatgccttgtctggaaatgttgccawtattgtcaatttgatgttcgttgagcattacagaacgctcagtgcttttggcgagcgggtggaagctgggttgaggaggagcgtctgtgccctggcacac

SEQ ID NO: 3118 - DNA, 201 bp, Homo sapiens
cttcaacgtacaaacaggtcctccttggagagacacctctccactaagcacctgcctccctgaacatgtattgtatattgttttcttccagcctattccayacacctcagaggagagaagcctcatgtatgcttccgcactgattaatttatgcagtctttcactcactcaacacatacttgtcaggccttattatctact

SEQ ID NO: 3119 - DNA, 201 bp, Homo sapiens
ccctcgtgtgcccctctgcccttaggatgcggaatttggtcagagccgttcatgtcagagctcagcagaatggcagctgaaccctgggagagcactgcctrttctgagaaaggcctgcaattgtgtcttcacgatgcttttccaagacagccaaggcaggtataattttcctcagcaagaaagaggaacctcggaggtgtg

SEQ ID NO: 3120 - DNA, 201 bp, Homo sapiens
aaagaaacaggggagaagaacaaaaaagtttagtttcaacaaatcttcatccatggcactcataagtttttgtaagatgggggagtgcttttatggcaaamgtcgatatttaagaagtttgttctaaagccctcctcactcaaaaatcctacaattccagaatcttgtataaaactatgttgctaacttgcactatcagct

SEQ ID NO: 3121 - DNA, 201 bp, Homo sapiens
aataagatgggccccaaagaaaatgtaaaatgctaagcaaattgcacacttgtattacttttccacctgaaacgtatcctgttatattgttcgggacaaartctagagaatgcttatcaccacccatggtttaggtgacagcaacttcagtctatagagagagtcctccaagcagcacgttcagagaacatggcttcttca

SEQ ID NO: 3122 - DNA, 201 bp, Homo sapiens
tgagaggggtgaagggtggcaggaaagaatttgatttccaactgtattgaatcagatgtgacttatacttgtttatttttaatattttatcagcatctttrcagttcaagtggatgaaaacagaagatacatgcaaaacctgacagttgaacagcctatcgaagttaaaaagcttttcgttgggggtgctccacctgaatt

SEQ ID NO: 3123 - DNA, 201 bp, Homo sapiens
ggccacccaagtgagatcctcgggctcagccctagccttttcagctccccagggaaactgctgccagacgagatcttggaggatgacatggagtacctgamccaaggtgaggcccaggcctggccctgatgcttagttcattcgggaaacatacggtgcccaggcctgcgctgggccatcctgggtgcccggggtgaatcc

SEQ ID NO: 3124 - DNA, 201 bp, Homo sapiens
tgtctcattttctcttctgtaaaatggggacaattacagtgaattctgtgaattcattcatgtccctgacacatggtgtgagctcagtcattacctttgcsagggttgcaaggatgtaatgagatggcagatgtgagcacagctcccagacccgaaggtgctgtatgaatgggagggagcagtgagtgttatttgggaaat

SEQ ID NO: 3125 - DNA, 201 bp, Homo sapiens
tttaaaaaagaaatggaaaaatcttacaaaccattcaaggaaagtagctttggattcagcctgaagggttgagatctagcttagtctcttaaccaacttgrgaactcaggcaagtaatgtgatctccctgaacttgtttcctgcctgtaaacggggcacaataacacctatcttgtgaagttggaaggattaagagagatt

SEQ ID NO: 3126 - DNA, 201 bp, Homo sapiens
gaaagaaagggaatagagagaacaatgggtgaaggaaaagagaaggggaggtcagaccccagggctagtggccaaggagatgcacctcggcggtaacgctrgagccccaccaagcatgtgtttgtcctcccatcccctatgattggcacctcccgggagagctccaggtaggagatcttgtaacccaaggctcatctgtcc

SEQ ID NO: 3127 - DNA, 201 bp, Homo sapiens
cgcgcccagcgactagtctttaaaaaaatgaataatataaatttttttaaaagatgaaaacatatatataccctgtaacccaagagtcccactcctcagamtcttctcaaaccacactcttacccatgtgcaccagaatacccacacagcaccagaaaatgtccaaatgaccatcaaaagtggagagtacaaataaattgt

SEQ ID NO: 3128 - DNA, 201 bp, Homo sapiens
gtagttccctgagaactgccttccagctgggatggctgggcagaaggcggactgtagtcatcacagaggaatgctggccgtggggtcagccacttccttcyctccccagggcttggagctcaggccagggattatggtgggttggccctggatctgagacaagaaggctgggagtttgggtggcagagggagagtccagta

SEQ ID NO: 3129 - DNA, 201 bp, Homo sapiens
ggcaaggccccagccaggcctctgtccctgggctgcttggtgtggggatgggggatccagaaccccagcaggagggcagatggggagcacagggcaggagrggcaggacaaagcctttggccctcagggagggtgaccaactggccctggtttgcctgggactttcccagttttagcactgaaagtcccaaatcctgggaa

SEQ ID NO: 3130 - DNA, 201 bp, Homo sapiens
cactccatgcaacaggtcctttgaatggcatgtgttcgtggctgccataaactgcagcctgccttttagccttacctcctttgctcttgctctctgacccygtgttctggcaacactggcctgactacacgccgtatcacatacaaccaactgcccataccaaccccaaccctgacctttgctcactcagttctttctgcc

SEQ ID NO: 3131 - DNA, 201 bp, Homo sapiens
cgagtacctctcacaccttctcacacactacacatcttagcgatggccgagtgagcatgttggctctctggactcctcagtctgttggtctgggctgcgcyaggctcaggctccctgcctcccccccaaccttgatccccttgcttcttgaacctgatgctgggcctcacattctccgttgattctagctcttaaatcctg

SEQ ID NO: 3132 - DNA, 201 bp, Homo sapiens
gactcaggaagacagtgttgcacttgggaaaatgtagcagcctcccccaagccagttggttgtgggcccacagcatggccctcttgccctcacttccctayctccctccgggtctccctttcctcacttgcccagaagtgctgcctggcccactgaaggcacagcaggctgctgcagagggtctagtgctttttttttttt

SEQ ID NO: 3133 - DNA, 201 bp, Homo sapiens
catagcctcctaactggttctactctttctctcagtttattctcaacacagcatccagagtgatcctgttaaaatgtgagttacatcatgtcacttctctktaaaaaaccctctagtggctcctgtctcagaatcagagcccaagttcacacaaggacctcccttgaatgccgtgaacactgtggagcctctcactacctc

SEQ ID NO: 3134 - DNA, 201 bp, Homo sapiens
tgtccaggcaactgcatctccctttgggcactgtgttaagtgagtgaagggcaagatgagagggaggtgtggatggacaggtggagtgggccagagcctgrgacctttggctactgtctgcggagtttaggcctaattctgtagacttaatttagggcctcaatagatggacatagtgtaatgacctgttctctagggaag

SEQ ID NO: 3135 - DNA, 201 bp, Homo sapiens
tgcaagttcctaatctgaacacagaggccagggagtaagcatcatctggagcccagagctgactgtcattacccacaaacataaacaccctgagtctggcyttctccccaccctgccgaggttgtcagagcctcagcactggctctgccctgggtggcagcccctgggaagcccagctgccacctctctacaaatggccct

SEQ ID NO: 3136 - DNA, 201 bp, Homo sapiens; identical to SEQ ID NO: 1515

SEQ ID NO: 3137 - DNA, 201 bp, Homo sapiens; identical to SEQ ID NO: 1528

SEQ ID NO: 3138 - DNA, 201 bp, Homo sapiens; identical to SEQ ID NO: 1529

SEQ ID NO: 3139 - DNA, 201 bp, Homo sapiens; identical to SEQ ID NO: 1533

SEQ ID NO: 3140 - DNA, 201 bp, Homo sapiens; identical to SEQ ID NO: 1544

SEQ ID NO: 3141 - DNA, 201 bp, Homo sapiens; identical to SEQ ID NO: 1545

SEQ ID NO: 3142 - DNA, 201 bp, Homo sapiens; identical to SEQ ID NO: 1546

SEQ ID NO: 3143 - DNA, 201 bp, Homo sapiens; identical to SEQ ID NO: 1547

SEQ ID NO: 3144 - DNA, 201 bp, Homo sapiens; identical to SEQ ID NO: 2723

SEQ ID NO: 3145 - DNA, 201 bp, Homo sapiens; identical to SEQ ID NO: 2724

SEQ ID NO: 3146 - DNA, 201 bp, Homo sapiens; identical to SEQ ID NO: 2727

SEQ ID NO: 3147 - DNA, 201 bp, Homo sapiens; identical to SEQ ID NO: 2729

SEQ ID NO: 3148 - DNA, 201 bp, Homo sapiens; identical to SEQ ID NO: 2730

SEQ ID NO: 3149 - DNA, 201 bp, Homo sapiens; identical to SEQ ID NO: 2731

SEQ ID NO: 3150 - DNA, 201 bp, Homo sapiens; identical to SEQ ID NO: 2732

SEQ ID NO: 3151 - DNA, 201 bp, Homo sapiens; identical to SEQ ID NO: 2733

SEQ ID NO: 3152 - DNA, 201 bp, Homo sapiens; identical to SEQ ID NO: 2734

SEQ ID NO: 3153 - DNA, 201 bp, Homo sapiens; identical to SEQ ID NO: 2735

SEQ ID NO: 3154 - DNA, 201 bp, Homo sapiens; identical to SEQ ID NO: 2736

SEQ ID NO: 3155 - DNA, 201 bp, Homo sapiens; identical to SEQ ID NO: 2738

SEQ ID NO: 3156 - DNA, 201 bp, Homo sapiens; identical to SEQ ID NO: 2739

SEQ ID NO: 3157 - DNA, 201 bp, Homo sapiens; identical to SEQ ID NO: 3008

SEQ ID NO: 3158 - DNA, 201 bp, Homo sapiens; identical to SEQ ID NO: 3009

SEQ ID NO: 3159 - DNA, 201 bp, Homo sapiens; identical to SEQ ID NO: 3015

SEQ ID NO: 3160 - DNA, 201 bp, Homo sapiens; identical to SEQ ID NO: 3016

SEQ ID NO: 3161 - DNA, 201 bp, Homo sapiens; identical to SEQ ID NO: 3017

SEQ ID NO: 3162 - DNA, 201 bp, Homo sapiens; identical to SEQ ID NO: 3018

SEQ ID NO: 3163 - DNA, 201 bp, Homo sapiens; identical to SEQ ID NO: 3019

SEQ ID NO: 3164 - DNA, 201 bp, Homo sapiens; identical to SEQ ID NO: 3020

SEQ ID NO: 3165 - DNA, 201 bp, Homo sapiens; identical to SEQ ID NO: 3028

SEQ ID NO: 3166 - DNA, 201 bp, Homo sapiens
tagcatattagttatgcattcttttagtacagtattcttttattgattaccttggtaataatatgcatccttgttgcgataccttcttccttaaattagcrtatttactacttgctgaacattgcaagaatctttcagctgtttaactgcgtttacctgccttcctcctttgtgctattgttgtcgtatattttactgcta

SEQ ID NO: 3167 - DNA, 201 bp, Homo sapiens
gctgaatctgccaatgcagaatttgtggatatggagggcccgctgtatacactcacacactttttagtaaccgaggtgatttttcccttactaccacattrtgttatctccatctggagaaaggaaattccgtgcagggacatatgcaaaagtcctgagggcaggaggatgcttggaatattcaaggagcagcagaatggc

SEQ ID NO: 3168 - DNA, 201 bp, Homo sapiens
cagtatggagcttggcagacactgagggtcattctgtgtttgaggaaaggatgaggcaatgggaggccctgtgcatggtggtttaaggcagaattatctgrttgaccctggctctggctctaccactcccaagctgtgtgatctcaggtgactttacaaaacctctcagaagtaagacgaggatagtagcaggccctatgt

SEQ ID NO: 3169 - DNA, 201 bp, Homo sapiens
tttataaattgccaaggctgtggtactctgtcagagcagcagaaaacagaataagacaccatgttttcaccagcaaatgtcctaacccccccacgtttacyctttctggctcccgcttgttgggatgggtggggttccctattctgtcagtggccaccccctcttattttataggattttgctcttgttgctgcccccact

SEQ ID NO: 3170 - DNA, 201 bp, Homo sapiens
gttatctgtttgttttcttcctcctgtatatcctggtctgggtgctatggcagtctgcaacctacaattgcagaccaaaattttgaaaagaacctaatgtstccagccaaaagatctggaataggatgccctgcaagatgaagcttctttgagtatacctccctgtattaggctgttcttgcattgctgtaaagaaatatc

SEQ ID NO: 3171 - DNA, 201 bp, Homo sapiens
ggaggattaatcccttcaccccctcaaccccaaaatgaaaccaaaaagctacacctaggaatatcattaaaactgcagagaagcaaacacaaataagaaartcttgagcagccagaggggggaaaaccttacttacagagtagcaaacgtaaaagttgcatctgacctgtcctcagaagctatgcaagcaagaagagagta

SEQ ID NO: 3172 - DNA, 201 bp, Homo sapiens; identical to SEQ ID NO: 2659

SEQ ID NO: 3173 - DNA, 201 bp, Homo sapiens
tttcttttgctgtgcagaagctctttagtttaattagatcccatttgtcaattttggcttttgttgccattgcttttggtgttttagacatgaagtccttrgtttctgtattatgtccccatcgtacaggttggaaactggttctcagataaagtcacataaccaagaagttgtagaggcagaattagaactaaggcagtc

SEQ ID NO: 3174 - DNA, 201 bp, Homo sapiens
ccagcactttgagaggctgaggcgggtggatcacctgaggtcaggagttcaagaccagcctggccagcatggtgaaaccctgtctctactaacaaatgcaraaaataattagccaggcgtggtggtgggtgcctgtaattccagctactcagaaggctgaggcagggagaattgcttgaacctgggaggcagaggttatag

SEQ ID NO: 3175 - DNA, 201 bp, Homo sapiens
attaaaaccacaaaaggcatgaaaaagaggagaagaaaaaaataatgagggcaatgaatagaaaatggtaacaaatatggcagatactaatccagctatakaaatcatcactttaaatgttaatggtctgtgtccttggcctgggtagagtggcacctagttggtggtgcccatattagccagggacaaagcaaccctttg

SEQ ID NO: 3176 - DNA, 201 bp, Homo sapiens
gtgaaatggaagatgattctccacttctcactgagtatggctgtaaaataaacttgctctcctcgggcactgaagtacactggaaagatgacacatctacrgaaagcattcctctccaaaagagcttataagagaatgtgccccccaggttggttaaaacgtatgttaatcctatggcagagaagtttgatttagcctttg

SEQ ID NO: 3177 - DNA, 201 bp, Homo sapiens; identical to SEQ ID NO: 2855

SEQ ID NO: 3178 - DNA, 201 bp, Homo sapiens; identical to SEQ ID NO: 2856

SEQ ID NO: 3179 - DNA, 201 bp, Homo sapiens; identical to SEQ ID NO: 2857

SEQ ID NO: 3180 - DNA, 201 bp, Homo sapiens; identical to SEQ ID NO: 1841

SEQ ID NO: 3181 - DNA, 201 bp, Homo sapiens; identical to SEQ ID NO: 1842

SEQ ID NO: 3182 - DNA, 201 bp, Homo sapiens; identical to SEQ ID NO: 1843

SEQ ID NO: 3183 - DNA, 201 bp, Homo sapiens; identical to SEQ ID NO: 1844

SEQ ID NO: 3184 - DNA, 201 bp, Homo sapiens; identical to SEQ ID NO: 1845

SEQ ID NO: 3185 - DNA, 201 bp, Homo sapiens; identical to SEQ ID NO: 1846

SEQ ID NO: 3186 - DNA, 201 bp, Homo sapiens; identical to SEQ ID NO: 1847

SEQ ID NO: 3187 - DNA, 201 bp, Homo sapiens; identical to SEQ ID NO: 1848

SEQ ID NO: 3188 - DNA, 201 bp, Homo sapiens; identical to SEQ ID NO: 1849

SEQ ID NO: 3189 - DNA, 201 bp, Homo sapiens; identical to SEQ ID NO: 1850

SEQ ID NO: 3190 - DNA, 201 bp, Homo sapiens; identical to SEQ ID NO: 1851

SEQ ID NO: 3191 - DNA, 201 bp, Homo sapiens; identical to SEQ ID NO: 1852

SEQ ID NO: 3192 - DNA, 201 bp, Homo sapiens; identical to SEQ ID NO: 1853

SEQ ID NO: 3193 - DNA, 201 bp, Homo sapiens; identical to SEQ ID NO: 1854

SEQ ID NO: 3194 - DNA, 201 bp, Homo sapiens; identical to SEQ ID NO: 1855

SEQ ID NO: 3195 - DNA, 201 bp, Homo sapiens; identical to SEQ ID NO: 1856

SEQ ID NO: 3196 - DNA, 201 bp, Homo sapiens; identical to SEQ ID NO: 1857

SEQ ID NO: 3197 - DNA, 201 bp, Homo sapiens; identical to SEQ ID NO: 1858

SEQ ID NO: 3198 - DNA, 201 bp, Homo sapiens; identical to SEQ ID NO: 1859

SEQ ID NO: 3199 - DNA, 201 bp, Homo sapiens; identical to SEQ ID NO: 1860

SEQ ID NO: 3200 - DNA, 201 bp, Homo sapiens; identical to SEQ ID NO: 1861

SEQ ID NO: 3201 - DNA, 201 bp, Homo sapiens; identical to SEQ ID NO: 1862

SEQ ID NO: 3202 - DNA, 201 bp, Homo sapiens; identical to SEQ ID NO: 1863

SEQ ID NO: 3203 - DNA, 201 bp, Homo sapiens; identical to SEQ ID NO: 1864

SEQ ID NO: 3204 - DNA, 201 bp, Homo sapiens; identical to SEQ ID NO: 780

SEQ ID NO: 3205 - DNA, 201 bp, Homo sapiens; identical to SEQ ID NO: 1866

SEQ ID NO: 3206 - DNA, 201 bp, Homo sapiens; identical to SEQ ID NO: 1867

SEQ ID NO: 3207 - DNA, 201 bp, Homo sapiens; identical to SEQ ID NO: 1868

SEQ ID NO: 3208 - DNA, 201 bp, Homo sapiens; identical to SEQ ID NO: 1869

SEQ ID NO: 3209 - DNA, 201 bp, Homo sapiens; identical to SEQ ID NO: 1870

SEQ ID NO: 3210 - DNA, 201 bp, Homo sapiens; identical to SEQ ID NO: 1871

SEQ ID NO: 3211 - DNA, 201 bp, Homo sapiens; identical to SEQ ID NO: 1872

SEQ ID NO: 3212 - DNA, 201 bp, Homo sapiens; identical to SEQ ID NO: 1873

SEQ ID NO: 3213 - DNA, 201 bp, Homo sapiens; identical to SEQ ID NO: 781

SEQ ID NO: 3214 - DNA, 201 bp, Homo sapiens; identical to SEQ ID NO: 1875

SEQ ID NO: 3215 - DNA, 201 bp, Homo sapiens; identical to SEQ ID NO: 1876

SEQ ID NO: 3216 - DNA, 201 bp, Homo sapiens; identical to SEQ ID NO: 1877

SEQ ID NO: 3217 - DNA, 201 bp, Homo sapiens; identical to SEQ ID NO: 1878

SEQ ID NO: 3218 - DNA, 201 bp, Homo sapiens; identical to SEQ ID NO: 1879

SEQ ID NO: 3219 - DNA, 201 bp, Homo sapiens; identical to SEQ ID NO: 1880

SEQ ID NO: 3220 - DNA, 201 bp, Homo sapiens; identical to SEQ ID NO: 1881

SEQ ID NO: 3221 - DNA, 201 bp, Homo sapiens; identical to SEQ ID NO: 1882

SEQ ID NO: 3222 - DNA, 201 bp, Homo sapiens; identical to SEQ ID NO: 1883

SEQ ID NO: 3223 - DNA, 201 bp, Homo sapiens; identical to SEQ ID NO: 1884

SEQ ID NO: 3224 - DNA, 201 bp, Homo sapiens; identical to SEQ ID NO: 1885

SEQ ID NO: 3225 - DNA, 201 bp, Homo sapiens; identical to SEQ ID NO: 1886

SEQ ID NO: 3226 - DNA, 201 bp, Homo sapiens; identical to SEQ ID NO: 1887

SEQ ID NO: 3227 - DNA, 201 bp, Homo sapiens; identical to SEQ ID NO: 1888

SEQ ID NO: 3228 - DNA, 201 bp, Homo sapiens; identical to SEQ ID NO: 1889

SEQ ID NO: 3229 - DNA, 201 bp, Homo sapiens; identical to SEQ ID NO: 1890

SEQ ID NO: 3230 - DNA, 201 bp, Homo sapiens; identical to SEQ ID NO: 1891

SEQ ID NO: 3231 - DNA, 201 bp, Homo sapiens; identical to SEQ ID NO: 1892

SEQ ID NO: 3232 - DNA, 201 bp, Homo sapiens; identical to SEQ ID NO: 1893

SEQ ID NO: 3233 - DNA, 201 bp, Homo sapiens; identical to SEQ ID NO: 1894

SEQ ID NO: 3234 - DNA, 201 bp, Homo sapiens; identical to SEQ ID NO: 1895

SEQ ID NO: 3235 - DNA, 201 bp, Homo sapiens; identical to SEQ ID NO: 1896

SEQ ID NO: 3236 - DNA, 201 bp, Homo sapiens; identical to SEQ ID NO: 1897

SEQ ID NO: 3237 - DNA, 201 bp, Homo sapiens; identical to SEQ ID NO: 1898

SEQ ID NO: 3238 - DNA, 201 bp, Homo sapiens; identical to SEQ ID NO: 1899

SEQ ID NO: 3239 - DNA, 201 bp, Homo sapiens; identical to SEQ ID NO: 1900

SEQ ID NO: 3240 - DNA, 201 bp, Homo sapiens; identical to SEQ ID NO: 1901

SEQ ID NO: 3241 - DNA, 201 bp, Homo sapiens; identical to SEQ ID NO: 1902

SEQ ID NO: 3242 - DNA, 201 bp, Homo sapiens; identical to SEQ ID NO: 1903

SEQ ID NO: 3243 - DNA, 201 bp, Homo sapiens; identical to SEQ ID NO: 1904

SEQ ID NO: 3244 - DNA, 201 bp, Homo sapiens; identical to SEQ ID NO: 1905

SEQ ID NO: 3245 - DNA, 201 bp, Homo sapiens; identical to SEQ ID NO: 1906

SEQ ID NO: 3246 - DNA, 201 bp, Homo sapiens; identical to SEQ ID NO: 1907

SEQ ID NO: 3247 - DNA, 201 bp, Homo sapiens; identical to SEQ ID NO: 639

SEQ ID NO: 3248 - DNA, 201 bp, Homo sapiens
ggttcctctatcttttggcatgaccccagaagtctttgataacttccttgctttctgatgtgacaagacatccagggccagattgtccatatcctgccccrgatgcacgatgcactgtttctccaagaatccctgtgtcctttgctgatgatgccatgattttaagttctctaatatagttttatctctttgtttcagata

SEQ ID NO: 3249 - DNA, 201 bp, Homo sapiens; identical to SEQ ID NO: 1653

SEQ ID NO: 3250 - DNA, 201 bp, Homo sapiens
accgtgttttcatcgtgtgtgagcagggaagggaactttactgcctttgttaggcctatgccgaggattcgtgggatttgctttatcagagactctgaagscaaaaatgcatcatacttcttggccagcttcttgaccagattcttattcttgagtttttttggcacctcagtgtccacttggggggatatccgtggcctt

SEQ ID NO: 3251 - DNA, 201 bp, Homo sapiens
gcatcatacttcttggccagcttcttgaccagattcttattcttgagtttttttggcacctcagtgtccacttggggggatatccgtggccttggtctcgycacagtgctgctgttcccccaggacccacacttgggacagggagtggacttaagcctgacggtgcccgagaagcgcttgtccttctgggggtcatagttc

SEQ ID NO: 3252 - DNA, 201 bp, Homo sapiens
tatatttaaaaattagagcattgctaaaagtgaaacatcaatttatgggaaaattaatactcagaagtaggatttctacttacttttatttctctcacctrtaggtgaagtatttgactatttggttgcacatggcaggatgaaggaaaaagaagcaagatctaaatttagacaggtatgaattaatgtgtctttactatg

SEQ ID NO: 3253 - DNA, 201 bp, Homo sapiens
tgtgatactaggatgggctgatgctgcgttcaggaaggccagggccctggccgaagggagtcaggcctgggtacaggggaggcacgtagaggtggcggtgyaccgagtccgctcagtgggagagagaggagtggcacgtgcagaggcaggcgccaggggcctggctcatctccaactcaggcgtgggggcagcggctgggc

SEQ ID NO: 3254 - DNA, 201 bp, Homo sapiens
acatcctgtactttcctacctcccctttggctgtgatcccctctactcaaaacaaacactcttccctatcttcattgcattttgttgaaatcccatggctsttcatagctctcctcagatgcaggcccacccccacccgtgctgtttcctccttgtctcatcctgcctgtcacgttctcctgctcggcgggctccacctct

SEQ ID NO: 3255 - DNA, 201 bp, Homo sapiens
gcccccgcacccagccttgcttttccattttgtatagttatcattgcatggatttgaggggaggcaatcaccaggtagccttaggactctatgtcccttgytctaggtctcttccacttgtgccctttttttatgccagtcaccagcaggctatttcaggtcctcattcaccgtttgtccttttggtctttctaaaagccc

SEQ ID NO: 3256 - DNA, 201 bp, Homo sapiens
actttttctccacagcacttactgtcctctgatacactatatgtttattcatttattgccccctcccccaactagaatgtaaactctatgaggaaaaggaycttgtgttcactgctgcatctccccagaacctacctagaacagtgccttgcagttagtagacattcaggaaatatttgttgaatgaatgaatatactcag

SEQ ID NO: 3257 - DNA, 201 bp, Homo sapiens
cctgggcccaagcagtccttccacctcagcctcctgagtagctgggaccagaggtgtgtactaccacatccggctgattttttgtattttctacagagacraagcatccccatgttgctcaggctggtctcgaactcctgggctaaagtgatccttctgcctgggcctcccaaagtgctgggattaaagggatgagccacc

SEQ ID NO: 3258 - DNA, 201 bp, Homo sapiens
aacttttcatgtaattatttttattcaagttacatattacacacagtttaaagagtcaagacttgttaaaaaagagtcccctagactcactggtttccttrtctcccaggatggccacttttaatcttttaaagtgattctttagtcttttaaatgattctttcatactttataacatgcttgtagtcttacttgtttttc

SEQ ID NO: 3259 - DNA, 201 bp, Homo sapiens
ccctttttcctcagaattttgttttctgtcttatatagcatctgacactccgatttggagagagagaatgctattttgagtcttgcttatttttctgtttrtttaaggctgattggaagttttgtgcatttggatggatcttgaatacaacagtgggacacactgttatttctttgtggtgctcttgataccaatatattt

SEQ ID NO: 3260 - DNA, 201 bp, Homo sapiens
aatcacaggctttcctcatttgtgtgatttttttattttgttcatgtcttcaagagtggagccctaagaagaaagctgagagctcccagtaaaggggtgaygagtgcctggcttagcctcatagaggccagaggaacgtcggtctttacactgggacattccacacacgcaacacagagttattttctatggacagttgag

SEQ ID NO: 3261 - DNA, 201 bp, Homo sapiens
ttctctcccaacaattgaagatacctgcgttaacacataataaattctcatatgtgtcctgttatttctccagtctgtttatttagtcctatacccatacygtggtgtttttattactgcagctgtggattgtatgttttaggtcaagttcccctcctgatgattcttttttttttctctctctctttttttggtgagatg

SEQ ID NO: 3262 - DNA, 201 bp, Homo sapiens
attcagtgttaaccaatcatatatagtaaagaaggtgttcttaaacagacacacacataaaacaaacttatgtattaatctgctgttgcaaaatgttgtgrccagaggcttgcagaaacctaacccccagaagcaatgatttcgtattcactaattcagtgagcacagtaactgcatagaatgaacaatgagaattgactg

SEQ ID NO: 3263 - DNA, 201 bp, Homo sapiens; identical to SEQ ID NO: 1551

SEQ ID NO: 3264 - DNA, 201 bp, Homo sapiens; identical to SEQ ID NO: 1613

SEQ ID NO: 3265 - DNA, 201 bp, Homo sapiens; identical to SEQ ID NO: 1554

SEQ ID NO: 3266 - DNA, 201 bp, Homo sapiens; identical to SEQ ID NO: 1617

SEQ ID NO: 3267 - DNA, 201 bp, Homo sapiens
tttttcagggaaagtgctggtgcttcagagtcattggcagacattccatgtttctgctgttgctgctggctgctgctatttttgttattattattttctaygtccgttgttgtaagaagaaaacatcagctgcagagggtccaggtgagaaaagcgggcagtttctggagatggtaaggcccctgtctgggcagtagggtc

SEQ ID NO: 3268 - DNA, 201 bp, Homo sapiens
agctttgtccttaaaactagtcttttgttcacaaacaaaaactgcatattcttgttgtaatgtgcttcagagctgatatagccactaagctcaaactcttkatatttaaaacttatttctcttagcttttgggactttcccaatccataaatttgacaaaatcgggaacatacgtctttggttttagggagctgaagaacc

SEQ ID NO: 3269 - DNA, 201 bp, Homo sapiens; identical to SEQ ID NO: 815

SEQ ID NO: 3270 - DNA, 201 bp, Homo sapiens
aagtcagccaggtcttgggtgaggtcagctctctccctttccatcttggctcgagtggtcctttcagcttctagtttctctttcaaatcctttatttgagyctgtagcaagaaataattttgacttttactaagcacttgtagcaagagctttactctatttttttttaatcacaaagctaacatgaaacttttggttccc

SEQ ID NO: 3271 - DNA, 201 bp, Homo sapiens
atgggaacactgccagtgcagcccctccccagcctcttgggcccccagcacaccctgcaggtttttgttctcccgcttgaaggtctccagatgttccaggsactcctcataggcgttcttgagtttgaagagctctgtgctgagggagcgagcctccttctgcgaggactccagctccgactgcgactcctcatacttctg

SEQ ID NO: 3272 - DNA, 201 bp, Homo sapiens
cccttcgaacttggcggtggctccttctttgatgcagaggttccgagggggcaaaatgaaagcaggggcctctgtcaggggcatggagtcaactcttgagkgatccacactgagggaggttttggaaatgtgtgacgaggcaaccagcttcacatcccccatggtctgcaaaaaggaaggaagaggacaaggtcagatcag

SEQ ID NO: 3273 - DNA, 201 bp, Homo sapiens
ctctttcactgataagatattagctttgcaaacaaaattccttgttgaatggtaagactcacaggttccctgcagtaggtagcaataaaagcaaacacttstgtagcacttactagatgtggggaactcttccaagccctttataaataataaatataaataataaatagctcatttgctccttacaacaacactatgaga

SEQ ID NO: 3274 - DNA, 201 bp, Homo sapiens
ctttcaggagctccctcttagactgctgagtcatagtacaactattcttcagtgttctcttctcctttgagtacaaggtagacaaggaatgatcatgcctrtttgtagaagaagaagtggagtcccagtaacggcaagtgaccagtattcatttatgacaggtgacagaagtgaaatgagaggtcctatcactgctccggg

SEQ ID NO: 3275 - DNA, 201 bp, Homo sapiens
atactacaattttaatggcgagcatcaagatatattcattcactcaattaaaatatatttactaaatatctaccatgggccaagctagagacttggtatayagcagcagttacatgagtggggcatgtgtgttgttgtttgtgtggcgaccgtagaaacacagggctgcggaaggaatgggcatcatctgatatcccacat

SEQ ID NO: 3276 - DNA, 201 bp, Homo sapiens
accgtcatccaccagtgtcaaggtaatctggtttttggcttttccatcttggagttgagcggtgtacgaccctttgtcctcctcagacaagttctggatgrtcacttccaccaggcccttctctcggtcaaaattgattttgcggttctgaaaaggacaaactccagagtccttttccctgttctgggaactttgttgtgg

SEQ ID NO: 3277 - DNA, 201 bp, Homo sapiens; identical to SEQ ID NO: 2546

SEQ ID NO: 3278 - DNA, 201 bp, Homo sapiens
ccagaatgggtgatcttctgttaggacatttatcttggccataactagaactggaggtagtagggcagcacttggcagaactgagcatatttttacatgtrattttgtgatttatttttgttcttggttgctaggaagggggcttagaattaacatccccagcatattatgaactgaggtttcttaatggtgcttttggag

SEQ ID NO: 3279 - DNA, 201 bp, Homo sapiens
ggagttcacctgggttatactgagggtagatattgcaaagtttacatagcggtggggcaagagctggagagagccaccatacagtagtactgtctaccccrctgaatcattttgtctggattctaatgggttagattatgtatgaaggttgtttgtctttgcagggtgctgggtaggactggatgtccatttggaccttcc

SEQ ID NO: 3280 - DNA, 201 bp, Homo sapiens
gggtagatattgcaaagtttacatagcggtggggcaagagctggagagagccaccatacagtagtactgtctaccccactgaatcattttgtctggattcyaatgggttagattatgtatgaaggttgtttgtctttgcagggtgctgggtaggactggatgtccatttggaccttcctgtaattttgtctggggattgca

SEQ ID NO: 3281 - DNA, 201 bp, Homo sapiens
tccttcaaagatataggggtcaagacatagttttcatagtttggatgtatttatataatcaaaaacaacatataacaacagccctcctttaaaaagtaggktcacctaaacaagtgacatcacattactactgagtccagagagcctgaatacactatggataacatatttctcaacaataaagaagcctgcattacacag

SEQ ID NO: 3282 - DNA, 201 bp, Homo sapiens
ccgtctgagactagtctgagaacatagtgttaaaatgtgtagattttaatcacctaaattcattgcagggtgggctaacaacccaagatgtgtgagtgccycgcctccactccagtcttacgactctccaaacgtagttttataagaaggccttctgggaaaaaaactctatggaaaatggagtaggcctggaagaattac

SEQ ID NO: 3283 - DNA, 201 bp, Homo sapiens
tggtgatgacagtacaactgggagctttgtgccctgtgttcctaggccagtgccaggcccacttgaggcgctcactaactatgatatgaacgaatgaatgsttgagtgaattggtccccagaagcggtcagcctctccgccaaggcagaggggaagggccgggaggtgcacgtgggatgaatggaaacatagtgattggcc

SEQ ID NO: 3284 - DNA, 201 bp, Homo sapiens
cagaggtaacaaacagcatgcacaagtgtttatagagcagcccagggatgggctagaaaagtgggcaggactggaccacagaagggctttgtatggtgtgwaagcatttaggctatcctgaggagcgtaaatgaaagatttgaagcaaaagaaacatttagctgatttgatttttagatacaccaaaatggagtctacatg

SEQ ID NO: 3285 - DNA, 201 bp, Homo sapiens
ttttggaacaacaggaaaaatttgagtatgattttggtactagttaagatgaacatttcctgaaatggaaaggtggagactgtgattgaaaaaagcagagyacaaaagagtagcctcagtatgatcttattttgtttggtatgcctacagaagatctggaaagatagacatggtggtgttatgtgtgatttggaggaactg

SEQ ID NO: 3286 - DNA, 201 bp, Homo sapiens
gagttgaatagctgcaatagagatcacgtggccctcaaagtctaaaatatttactatatggccctttaaggaaaaagtttgcaaacctctgcacttgattyaaaaatttaaggaacaaccaaatgtgtggctctaaatgggataccattttggacatgaccaccaagggacatttttggaacaacaggaaaaatttgagta

SEQ ID NO: 3287 - DNA, 201 bp, Homo sapiens
gctcaatcttgctgtagtgtgaagaatatattggagaggggaagaggagaagcagagagacccttctaggattattgcagaagtttagtcaaaaggttgtmatgactaacactagggtggatgaagtggatatggaaggaaattgactcaggacatcatttggagggatgtgacgactgactggatgttgagggtgggtga

SEQ ID NO: 3288 - DNA, 201 bp, Homo sapiens
gtttttcatgtttttctggggtctacttggtcgaggggggttctgttcagccagtttagggggcttagaattttatttttatttcacaggcacaaccagcmcagctgctttggtaagtcagtgacattaaaaaaagaaatgtgtggcagggcgcgatggctcacgcctataatcccagcactttgggaggctgaggcagga

SEQ ID NO: 3289 - DNA, 201 bp, Homo sapiens
actgtatgaaaaccaatgtctagccagatccagctaaagatagtaagtagcttgaaaagctaagaaagtaagagatacgggtgggagggaatgataggaasaaaaacaaggcaaagtggaaaattgctacttctcattaggggagaaaactgaaggattcatacattcagtagcatgtcaccctatatagatcagtaatgt

SEQ ID NO: 3290 - DNA, 201 bp, Homo sapiens
actgaaatggagattctttgagaaaactccaagagaagatggggttcctaggttatgtatctgtgacttggtgcagagaaagaggtgctgggtctcaagasaatccacatcagaaacagctggagaacaacaagcacagaggagtacaggcgtcaggcacaggcctgagcatggagactggggcagcccactaaacagtga

SEQ ID NO: 3291 - DNA, 201 bp, Homo sapiens
agggaaagttttttccatctgtaattagagaaaaaagttttactagtgtattatattccacagcaatgcagtgcatgttctcaatgaatcaaagctattayggaaagggagcttatacatggagaaaatacatctcattatatccttctaaagggtatcatgtctagttaatagatccttacaagagtatgaacatgggga

SEQ ID NO: 3292 - DNA, 201 bp, Homo sapiens
aatgtatggctatcatagcatcttggttacaagtaattgactatataagagtacatttcttcattaatcagattttatttattttatttgaatcttcctaragcatccatttgtgaattttttacatgaaaatgtatgcaacctaactttttttttctttttttagacagagttttgctcttgttttccaggctggagtgc

SEQ ID NO: 3293 - DNA, 201 bp, Homo sapiens
ttcacggtatcagaaagctgtcttgaatttaaaagaggtgaacctgagacgttattagggagcaaacagaatacaccaaatacaatataacatgtaacaawttctttaactaaatttttctggccataaattatagctatattaaaggaagaggaggaaggcagcataagaaagaaaactgataatgaaagaacatgaact

SEQ ID NO: 3294 - DNA, 201 bp, Homo sapiens
gatgttcaatagctgtttatttttttctgttatcaatagcttgtaatcattagggatggaatcatttatggatgagaggtttttttcagaatatctatagyagttttaaaaattcaaaattttcctatctagtaaatgcatgtgaccttttaatatatatgcatatataatatatagcatgtacatttaatatgccaaata

SEQ ID NO: 3295 - DNA, 201 bp, Homo sapiens
atgattgtgccacttcgctccagcttgggggacagagtgagactccatctcagaaaaagaaaagaaaagaaaagtgtaagtcatgtgatgtctatactgtyctaatttctgcaattttgaaacaagatatggtagaaaaatgatctgatttttaatcaaaagattccactggtttgagagactaattcctacaacagtcaa

SEQ ID NO: 3296 - DNA, 201 bp, Homo sapiens
gaaacagattgaaaaaattagcttaaaaataaccgtgttttaaaaatgtgcaggcactgggagaatgtaaatgagaatgttcgtagtattgtttccaaggrgtattaaacatttttgatatgtttacataacagtatttgttaataaggtaagaataaagcaactggttcatattaaagtgactgcaaaatgattttttta

SEQ ID NO: 3297 - DNA, 201 bp, Homo sapiens
aatttcccttgggtattataactccacttaaggaaagttttgtttttcatgatcctcttctcaaaaacagatattctggcacttaggagacagaaatgtaycatttgacctttaaacttctgttttattagtgtaaccacaagcaacagagtcactgactggcatgtttgcactttatggcctttagcacttaaaattatt

SEQ ID NO: 3298 - DNA, 201 bp, Homo sapiens
cgctgaattttatatagtctaggaaacattttcacattggttgtttcagtcaaatacaaagaagttacagaacagcatcgagtacctaagagagaccaaargcatttccttctgtaaagccctgcagctgagggcttacatccgcctggtccaatcagttcatttccaaacaaaggtaggaaatggctgcatcctagtatt

SEQ ID NO: 3299 - DNA, 201 bp, Homo sapiens; identical to SEQ ID NO: 1548

SEQ ID NO: 3300 - DNA, 201 bp, Homo sapiens; identical to SEQ ID NO: 1549

SEQ ID NO: 3301 - DNA, 201 bp, Homo sapiens; identical to SEQ ID NO: 1550

SEQ ID NO: 3302 - DNA, 201 bp, Homo sapiens; identical to SEQ ID NO: 1552

SEQ ID NO: 3303 - DNA, 201 bp, Homo sapiens; identical to SEQ ID NO: 1553

SEQ ID NO: 3304 - DNA, 201 bp, Homo sapiens; identical to SEQ ID NO: 1554

SEQ ID NO: 3305 - DNA, 201 bp, Homo sapiens
gggctcacattttacgttcaggatgagcgacttcttgaaggtctccttggtgaaggcttcactgaaggcctcacatgtgagggtcagaccgttgtcctccygccgcgccaggaatgtcaggttggacatggagatgtgaccgccatgcagtccctggcagggagtgagcttcagacgtggggactgcagcacccctatcca

SEQ ID NO: 3306 - DNA, 201 bp, Homo sapiens; identical to SEQ ID NO: 2190

SEQ ID NO: 3307 - DNA, 201 bp, Homo sapiens; identical to SEQ ID NO: 2192

SEQ ID NO: 3308 - DNA, 201 bp, Homo sapiens; identical to SEQ ID NO: 2196

SEQ ID NO: 3309 - DNA, 201 bp, Homo sapiens; identical to SEQ ID NO: 1436

SEQ ID NO: 3310 - DNA, 201 bp, Homo sapiens
tgcagcgcgccacatctacagcatgaaaagagatcaacttccccagctctaatcacccaggaaagcttcggaacctccttcccccatcctcgtgggaagtkccctgcccttctttttcctcccttaccagacattttgctggatcatcaaacaaaatattcttgataggcttggttggtaattatcagagagcagaggttg

SEQ ID NO: 3311 - DNA, 201 bp, Homo sapiens
tgtagaagtcagaactttcttgagcgaaaaatatatctgcagggttcgggtgagcccaggtgttgcttgttcaatatcccaagcccagaaagatgagttcrtccttaaaggaaatgacattgaacttgtttcaaattcagctgctttgactcagcaaaccacaacagctaaaaaccaggatatcagaacattttggatggt

SEQ ID NO: 3312 - DNA, 201 bp, Homo sapiens
gagttcatccttaaaggaaatgacattgaacttgtttcaaattcagctgctttgactcagcaaaccacaacagctaaaaaccaggatatcagaacattttrgatggtatctatgtctctgaaaaagggacagttcagcaggctgatgagtaaaatctaagagttgtacagctacagaaacaagatgtcagataattcctaa

SEQ ID NO: 3313 - DNA, 201 bp, Homo sapiens
tctccataatattctctagtaaggcccgcgtaagccagagggaatttaagaatgtagagaattttctgaggaacacattatgagggttacaagaatactcyattttcactggccatagagactgagttatgatatagggtaacaaaccaaagccagagtccacagaggcttaggattgtacagggtgatataggcgactac

SEQ ID NO: 3314 - DNA, 201 bp, Homo sapiens
ctgggccccaaccccagatagctttttccaccctccatcaaatgacgaaaggggccatctatgagtggtcaaagtctcaagcaagaatgaaattgagaatsatagtgtctaccaaatcttatgctcctgcaatatcacaaatcagtcctcagattaataatagggaccaaggtaacaggtgttcctaaatgatgctcttag

SEQ ID NO: 3315 - DNA, 201 bp, Homo sapiens
cccactccccgagatatttcttaagctcaaactggagctcaacctgtctaccatgcagagactgctcaccactcactcactcacttagagccagttgctayggtcactcatatcaaaggcaagagagtctttgaagctggtattattttctgcttagtctatcaagagtaatcagggtctgggaacatcaccttttaactg

SEQ ID NO: 3316 - DNA, 201 bp, Homo sapiens
caaaagaaacctttgttcttttcaaccattgagatttggatgttgtttgttactgcaaaagatgttgcttgttactgcaaaagaacctggcctattccaamtgataaagtgaagtgctgctgcacaacaacaaaatgtggcagtggcttagaagccaggcagcagggagtgaagaaatggattctggagactggcacagca

SEQ ID NO: 3317 - DNA, 201 bp, Homo sapiens
gcccagacacgggctgatcatattctaatatttgagagggaaaaagagaacagcaagaattcctttcagaacttctgaggcatgtagaagtattatcaccrgagtcacatagagactcaagtctgaatttcatcacctctgctgctcggggttaacccatctgttaggtgcaagaggcacagtggctaggacctgccatac

SEQ ID NO: 3318 - DNA, 201 bp, Homo sapiens
ctatctcaaaaaaaaaagagtgaaatgtattccagcaggctagaaatatttccccaatcttctgttaataagaaaagcaagaaatgcctagaagtgtaaayaactttttaagcctatttggtttagggagaggaagggaggaaggaaggaagaaggaaggaagggagaagagaagaaaggtaggaagcacaatttctaata

SEQ ID NO: 3319 - DNA, 201 bp, Homo sapiens
aagcacaatttctaatatgttcatgattatatgagcctgtagaaaagcatagaaggcccccagttgttaatatttacaggagtggcagaatgagcaggttrtatagttggtggctagagatccaggaaaagggatggagaaaattctacacttagagctttcagtaaaagcagataataaaaaaataagaattacataata

SEQ ID NO: 3320 - DNA, 201 bp, Homo sapiens
aaattctaaaaagaacaactcgcattatatctaatttatttctgcattaaacagagacatcctctctattccaaatagcctgctcagaagttctcaatccrgctgccttttagaatcagctgagaagcttttaatattcaatttctggcctcctctcgcacatattctgtttaattcaggcatggcatccagacatgaata

SEQ ID NO: 3321 - DNA, 201 bp, Homo sapiens
caggaaaagggatggagaaaattctacacttagagctttcagtaaaagcagataataaaaaaataagaattacataataatggaaaataggagatacttcsgcacaacaagacccaaacaagctacgtaaaccccagaaaacaatctagttctgtaccagaaatgcagaattcacccaggtacagctgctatcagatttct

SEQ ID NO: 3322 - DNA, 201 bp, Homo sapiens
tggagaaaattctacacttagagctttcagtaaaagcagataataaaaaaataagaattacataataatggaaaataggagatacttccgcacaacaagamccaaacaagctacgtaaaccccagaaaacaatctagttctgtaccagaaatgcagaattcacccaggtacagctgctatcagatttctggaaggaagagc

SEQ ID NO: 3323 - DNA, 201 bp, Homo sapiens
gtctcacttttaaaaacactgtaggtgacgcctgaagattttttgttattcagaaccctggttccttcctcctgcttcatctcctgctctttctgaagccrtttcaaagtttttcttggcaactcaacagaacaattggaaaaagtatagagttttgaaatttcagctaaatgttatatcattagtttgggttaaggtagg

SEQ ID NO: 3324 - DNA, 201 bp, Homo sapiens
gggttaagatgtctccaataaagatacagttgacactgtggcttcttggttaaatctttcaattagaatagcttaagggaaaacatgctaaacttgtagcwgtctcaacaaagccattaataaataaaggcatggaagcacaaatacaaaggaataagcaaatacaagtatgcctagaaggaattgagggcttaattcttg

SEQ ID NO: 3325 - DNA, 201 bp, Homo sapiens
gcagttgatgttttaaacaaagcctatttcttgaaggctttttcagaattctagaatactctctgggggtcatttaggcttcctgcagtagctatcaagtrtacacagtgaactccaaatagcctaaatgagcaaagacatgaggtgaaaaaaactgaaaagattttctatcaatcgaggaaacaattttaaaaagctaag

SEQ ID NO: 3326 - DNA, 201 bp, Homo sapiens
aatcctttgttgtcatttcaacaatgtttacagtgtcttcaccaggggtagattccatctcgagaaaccactttctttgcttgtccgtgagaagcaactcmtcatcctttcaagttctatcatgagactgcagaaattcagtcatctcttcaggttccacttctaattctagttctcttgctatttctacctcatcttcag

SEQ ID NO: 3327 - DNA, 201 bp, Homo sapiens
gcgtggagcagccgaggggggagattgctttcaccacttcccagcatctattgcagattccaccctcaaacatgttgtaaggactctttattcaaggtaaygtttgaaccctgctgagccagtggcatgggtctctgagagaatcattaacttaatttgactatctggtttgtggatgcgtttactctcatgtaagtcaac

SEQ ID NO: 3328 - DNA, 201 bp, Homo sapiens
aagatactttcacttatgtcgtaatttctatgtcatttggtgtaggatgtagagatattaacgtttacacctaacttaagtttgtcatctaagacctgaargggttttgtctatcagctgcacccctgggtagagacacaaccttggggaaggcctcagccccatccctcgtacagcaggaatgagaacagccctgcctgt

SEQ ID NO: 3329 - DNA, 201 bp, Homo sapiens
gaatacataaatcccagaatatgtgcaacctgatcatagtacacagagatctctctatatatctcttttcttagttcatgctgttctttcaggtagaaagygccttattttgaattagttgtctttagagcaaaaatccctccaagagtgctgtgtggtttcctatgcacaacctggaatagtccattgcttcatgcctac

SEQ ID NO: 3330 - DNA, 201 bp, Homo sapiens
gcatgtaacacagccatgcttattaatgatgaggagacagccaatgaaaattaattttttcaaagatgaatagatatctagattttttcaagcacaactcrtttaagaaaatatcacctcactgagccccaaatgagttaggtctcacttagaaagtgtcccctagtgccaggtaaagtgcctcatatttgcaatcccagc

SEQ ID NO: 3331 - DNA, 201 bp, Homo sapiens
accctgcacttttatccctgaacttaaaataaaagttgaataagaaaaatagaaatgtacaaagctagaaaagagtgtagctcatcccatctgggaattawaccaaatcttacagctcatacataaaaatagtttgataaagattttcctaagtgtgccaagaatcctgaaaactaatcttccattatcgatcatgagcta

SEQ ID NO: 3332 - DNA, 201 bp, Homo sapiens
agctaattatgcaaaggacggctaagctctttgcctggttctcagtttgactaatttatatcatctctgttacggtgtcatgctcccctcacttgcaagtyaaaacagtgaaatatctctttgaatatattccgttctctcaccagttcatggtggcggcagggtcggggactcagcatttctccctttgttatggcctga

SEQ ID NO: 3333 - DNA, 201 bp, Homo sapiens
gaggaaacactcgcagtcttttgccagattcattgttagcagctgggatcctccatgcaattcaattcgagtccatctcaccagagtccacagaaagtttygcttgtttcccaagttgcccaaactttccttccgagagcattccattgtgctgaatgcaaacacgccgaggtcctccgtccccccactagactccagaga

SEQ ID NO: 3334 - DNA, 201 bp, Homo sapiens
tgagaaggactgtgcaacttgtactttcctatccctctgtctttttgagagccacatgaggattctctttgagcatgaagggcctaagggtaaaggtaaaygtttgcagaagcctagagtagaataagtcgttccctagaggcccctcacattttgaacactgttttgcatctgtttccctgacagcctcagaagaaacca

SEQ ID NO: 3335 - DNA, 201 bp, Homo sapiens; identical to SEQ ID NO: 2668

SEQ ID NO: 3336 - DNA, 201 bp, Homo sapiens
gctgtgtcttgtgaggcctgccgtactcagtccttctgagaccttgaagagaatttcttgtgcacacctacacaagaagtgggcattgtcacatggttgcwatgtgactgcacatgtataatgcctagtaattatcatgcaacatacagacagtacagccgagtggctgaatgggaaactgtacccaggacaagatgttag

SEQ ID NO: 3337 - DNA, 201 bp, Homo sapiens
gctaattgcataaggcttggatcattcaattctaacttcctctctatctccaaaatattgatgggagcaaagaaaagaacaaactccaccaggattcaaayaagaaataaactacaaatctctatcactcagggaattatttacataacactgcatgttctggtccagaaatacttatcatacctggattttgacaagcca

SEQ ID NO: 3338 - DNA, 201 bp, Homo sapiens
gctcccagaactaggaaacttatatttaactggtcagaagaaggtatgcaaagtggagaacagcccctgggttaccccaattgctggccagttccagcttsatgtgtcctgtgtgtctgaatgtgtctgttctgagacatatgagtacctctatggcagcacatgcaggcaaatccagaaccaccaaaacataataatcac

SEQ ID NO: 3339 - DNA, 201 bp, Homo sapiens; identical to SEQ ID NO: 2662

SEQ ID NO: 3340 - DNA, 201 bp, Homo sapiens; identical to SEQ ID NO: 2663

SEQ ID NO: 3341 - DNA, 201 bp, Homo sapiens; identical to SEQ ID NO: 2664

SEQ ID NO: 3342 - DNA, 201 bp, Homo sapiens; identical to SEQ ID NO: 2665

SEQ ID NO: 3343 - DNA, 201 bp, Homo sapiens; identical to SEQ ID NO: 2666

SEQ ID NO: 3344 - DNA, 201 bp, Homo sapiens; identical to SEQ ID NO: 2667

SEQ ID NO: 3345 - DNA, 201 bp, Homo sapiens
gccagcaatacagagagaagccgggcagggagccccaccgcccctgtgcatgatgagtccctcgtgggacctgtggacccatcctccggccagcagtcccragacacggaagtcctgcttgtcgggttagagcctggcacccgatacaatgccaccgtttattcccaagcagcgaatggcacagaaggacagccccaggcc

SEQ ID NO: 3346 - DNA, 201 bp, Homo sapiens
attggaagccatgaggagttgactcaagactcaagacttcaggtcaatatctcgggcctgaagccaggggttcaatacaacatcaacccgtatcttctacmatcaaataagacaaagggagaccccttgggcacagaaggtggcttgggtgagttacaaagggtaccttccgtctcccttactggttcttactttcagtaa

SEQ ID NO: 3347 - DNA, 201 bp, Homo sapiens
taagtctgcagaactgaccccctggagagtcaccaccttggtcacagacagcagagggaggaatcaggaagtctctgctgtagttgcgggatccaggggtstatgttctgagctgtgatcctgggatcaggaagctgcagccaccgctgaggttttggttctagagccaggcagcgtgagctccagtcattgcatccacac

SEQ ID NO: 3348 - DNA, 201 bp, Homo sapiens
ccggtccacagacattccagcacctggtggtaagaggtgagtgctgcgtggacccactgaggaaggctctggctgtgctgggggaggggagtttatgctcrtcctcatagaaggataagcaggaattaagtgggcaaaggagggagtgaggaagctctcactttctaggtagtaggaccagcatgaaccaaggtaggggat

SEQ ID NO: 3349 - DNA, 201 bp, Homo sapiens
ttgaggttaggattgctctccagttttataggtgaggaagctgagctcaagtggttttcctgtggcccacctgggtgtcatagcagagtgagccctggaayccaggcctgcctcgtcctgacttctgtgatctcgggcgatcacatagatcgcagtgttcgctcttgcatcatgtgtgtttgacaacttttctgggtgccc

SEQ ID NO: 3350 - DNA, 201 bp, Homo sapiens
tacttaataaaacaaaaagacgcatgactgacctgatttagaactctttgcatgagagacatgtgctgtgaagaatcatcttaccgtttcggagctggacrgtgccttagaatcatctaggccgatgtctttaccttcaggcccctgcagccctcaggaggggttttgctctatctgcagcactacctgtgcttttctgta

SEQ ID NO: 3351 - DNA, 201 bp, Homo sapiens
gttcagagatctctaggggtctcctagattctttcaaggtatttctgggtattgttttcataatactactaacatgttatttggcttctttactctcattktatcatgagtgtacagtggagtcttgcagattctatatgatttgggatgacactgtcactcttacagctaatggaatgtatgctttcatattgtttaaaa

SEQ ID NO: 3352 - DNA, 201 bp, Homo sapiens
tctttatgcaggactgttatttcaaaggatggtgtcccctccccaaccataagaacgatccaaacctgttttctggggcccagagtttgctgaggataggmctgggctgaagctttcattgctggtctgtggggtagaggtaagcctcccctgtgaagctggtaggttacatgctttggcaacatgaattgttatttctgg

SEQ ID NO: 3353 - DNA, 201 bp, Homo sapiens
ttagcccaacagtttcccacgcccgcccccacccccacaaccttgtttgtttaaagaccattaaagaacgtcttcaatttattctggattgagttttcctyaaaccaaaccacccctcagttcaccccccagagctgttgaggcccttcctgggggcttgtggctgtggctgcctcagatcagagcagaccctgggctgca

SEQ ID NO: 3354 - DNA, 201 bp, Homo sapiens
tgggaattgaggttttgcagaatcattggaagagctggtgtattagtttgctagggctaccagaacaagtaccaaaggctgtgtggcttgaacagaaatakactttctcatagttctggaggctgaaggtcaaagattaaggcaacggcaggtgtggtttcttctgaggcctccctcttggcttatagatgactgtcttct

SEQ ID NO: 3355 - DNA, 201 bp, Homo sapiens
gtttcttagcaaaatgagtactcatgcgcatgcacataaacacaccttcagttctgcccagactccttcctgtggatggggagagttgctgacacaggagkcagagtagaaacgcagcagcttgtgctaatggaaaaaggaggatgatggtttcagagcatgcattctgctctcctgcccacccctccacccgtctccagt

SEQ ID NO: 3356 - DNA, 201 bp, Homo sapiens
atattctgttttcttttctttcttttttttttttttcctgggtagatgactctatcactgtgttccaagaactgaaggatctccttaagaagaatgccacygtggaggcttttattgaatggttggatactgtggtagaacagagagttattaaggtactttttaatgacagattcagaaaataagttccttgtaaagagt

SEQ ID NO: 3357 - DNA, 201 bp, Homo sapiens
tatgtctggcttccttagctcaacattgtgtttttaagatacatccatgtttttgtgttcagctggagattgttctttcttactgctgtataatatctcaytttgtgaatataccactatttattgcccttaatttttgataaacacatgaccatatttctgtcaggcatatgcctgggaatggcgaagttaagttataat

SEQ ID NO: 3358 - DNA, 201 bp, Homo sapiens
gtgtatacctaggataagtaggtattcgtgaaaattcacagagtgtatacctaggataagtaggtatactgtgcaactagtcccaagatcaagaggcagayattgccaacaccccacaaattttttgtgtgtccctttcaagtcactatcagctcagagaaaccactatcctgacttttggcagaggtgattgactttact

SEQ ID NO: 3359 - DNA, 201 bp, Homo sapiens
taggttactctaatgaagcagaaaattccacttcaggaagttttctcaccatgagactaaaatgtactgtgttgctattgttactattagttctgtttacytgaagagatagtggaagctttgacgaaacataggttaagagtagggtggagtctaagctttagtttatcagagctggcttacaagtagattacaaagtgt

SEQ ID NO: 3360 - DNA, 201 bp, Homo sapiens
gcaaggagaattgagttcaactatttcttaagtataaagcctggttcttagacagagagcacgtcatgtcagcaataagaaggcagcaaccatatatgagrgaaatacagggctagtgagccagttaatgaattttattgagaaccgactaggagccagaccccattctagatgtgaggatatggtggtgatcaggccata

SEQ ID NO: 3361 - DNA, 201 bp, Homo sapiens
aaaccctggactcccatggaacaagcagtagagaaatggtgtcctctttaccacctatcaacactgtgttcatgggaacagcagctggaggcacttaaacmaccaatgtgggagggggtgctaaaactttaaaaaaaatctctactgtgcaaatatcattattcactcagacttccataagagtaaataaaaatgaatatg

SEQ ID NO: 3362 - DNA, 201 bp, Homo sapiens
gaggcacttaaaccaccaatgtgggagggggtgctaaaactttaaaaaaaatctctactgtgcaaatatcattattcactcagacttccataagagtaaakaaaaatgaatatgcagtggctgacattgttttaaagtcactggtactatggacaactccatagtgaatggagatacttgcagagcttgtcatgcacacta

SEQ ID NO: 3363 - DNA, 201 bp, Homo sapiens
aggcttggtgctcttggggctggtactgtttctgaagaatgctggggatttactctttaatctcagctcctttggaaatgagattaaggagtcaagtagtktggttaaacactataatttaaaaacatttgcatatcatatccatgcctatacatataaagaaattgtgaattgtagactatttgaaccttttcagattta

SEQ ID NO: 3364 - DNA, 201 bp, Homo sapiens
atagaaaatagaagctcctagaggatttttgagtagaaaagcaacgtggggaaagtgatgtttagggaatatctaacactagttggagagaggggctgaawtggatagcggagaaattagtctgaaaagggggctatttggaggttgtttctctcatctagatgtccggtggataaacacagagaatacttggaagcagag

SEQ ID NO: 3365 - DNA, 201 bp, Homo sapiens
cctacttcctaccaggaccacgaaaggatccccaaccccaaattatcttacttgttgatgtctgaagatcttaatttagttttaatattcaaaattctccsagatagagatcagtgttcactaaatacatccttcttttctaaaaaatatgctttccctcccatcatggttcagcttattaaattggtaattcattcaaca

SEQ ID NO: 3366 - DNA, 201 bp, Homo sapiens
gtctatgatgtaaattgtatctgtaaagtcccttttatcaagtaacataagatattcacaggttccagggattagaacatggacatcttgagagaatgttwttctacctaccatagaaaagatacctcacctaggtctttcagattaattaggagttaactaggcaagaaatgtgaaaaagaatattccaggaaataggaa

SEQ ID NO: 3367 - DNA, 201 bp, Homo sapiens
gatgtgggaggtactaaatagttaagtaaaataaacatttcggatggtcttatctcggagtcttctgatcttaataaatgtcaccagaataatctaaaacractctttagcaactctgcagggaattaaaatcagaaacattttgcgatttctaatctgtttaggttgctctgaaaggaaaaatgcctcattccagcaggc

SEQ ID NO: 3368 - DNA, 201 bp, Homo sapiens
ttttgggaccatgaagaagaggccaagagaactctagaaaaggcaacccagttatctagctgcattgaacttctgaaccagcctgggatgcacatttccartcttcctgttatgtaagcagtaaaatatccgttttgaccaaaacacacacacaaaaaccaaaacttgcctttaacatcacattcattctctaatccatta

SEQ ID NO: 3369 - DNA, 201 bp, Homo sapiens
agattactcagttctagcttttcctcattcttcaaataatcatactttctatcaatgaccatctccttttttttcttttcccatctttgcctcttgaagtytatggctgatatgacaattctttatcctctgcccctactccatggccaactatcactacctttcagcagtcattctagaagccttttctgaaatgatcca

SEQ ID NO: 3370 - DNA, 201 bp, Homo sapiens
agagaacacacaaagatatattacttttctggtgaagcaggaagttctgatacagcaataaggcacagacacatttaggctagtctaaaggtagatcttamatttttggctttttaattacctagtgaaatgcacagtaggtgcatttcctccattgctaacccccagcccacttctcagattcactcatatacccccagg

SEQ ID NO: 3371 - DNA, 201 bp, Homo sapiens
taatggacgtttctggctcaattctcagtctctttaatttgtgacaaagtgatattgaaaagctgaggaaataccttgatagacccccatgacataaaggyatatcgagacttaattgaggcaaaggctgagataagaaaattaatacacaggaatttaataaactctctcttctgcccctcttgtgcttggctgattttt

SEQ ID NO: 3372 - DNA, 201 bp, Homo sapiens
ttatattaaaaatggcaacatttcttgcctgtgaatttcaggggtaatatatttgtactatctgctacccctgcctgctacacacatgccgttttccacgygtttcttattgtctggacccctgtacaatgtattgtgcccattttgactttctactccccaaaggaagactcacctagaagatgtgcctgaaggtgacac

SEQ ID NO: 3373 - DNA, 201 bp, Homo sapiens
catgttttttcatataatatttttatattaaaaatggcaacatttcttgcctgtgaatttcaggggtaatatatttgtactatctgctacccctgcctgcyacacacatgccgttttccacgtgtttcttattgtctggacccctgtacaatgtattgtgcccattttgactttctactccccaaaggaagactcacctag

SEQ ID NO: 3374 - DNA, 201 bp, Homo sapiens
acttttcatgttttttcatataatatttttatattaaaaatggcaacatttcttgcctgtgaatttcaggggtaatatatttgtactatctgctacccctrcctgctacacacatgccgttttccacgtgtttcttattgtctggacccctgtacaatgtattgtgcccattttgactttctactccccaaaggaagactc

SEQ ID NO: 3375 - DNA, 201 bp, Homo sapiens
aaatctgcttattgccttgtgtcttttttgaaatctttttatatacattacttcatttgatatacagaattttaaacctagaagagccttatagttcaggrgtccatttctaccaatggaacactggcggcccagagagttggtggcattcataaatcacattacttataagaggtgtttgcatgacattttgaattgact

SEQ ID NO: 3376 - DNA, 201 bp, Homo sapiens
ttttttgaaatctttttatatacattacttcatttgatatacagaattttaaacctagaagagccttatagttcaggagtccatttctaccaatggaacaytggcggcccagagagttggtggcattcataaatcacattacttataagaggtgtttgcatgacattttgaattgactgctttgaagccatggccattttg

SEQ ID NO: 3377 - DNA, 201 bp, Homo sapiens
gccattttgacattagtgactttttctttttaccctaaaaatcaaacagtttaacaatcagctaattttttaattatggggaaatatgagcagcagacacmcatgtcctccccatgctacctgtggagaaaccatgaagccatcgcagactttcctctgtagtcaccaaatccacgtctccactgttgtgatatatacatg

SEQ ID NO: 3378 - DNA, 201 bp, Homo sapiens
aatattttttaaagatgtgagctcatctactttaatatgacactaaaggaatgttctggtgattttttccaggtcaaatggagctttcacagattgctggycatctgatgacaccacccatttctccagccatggcaagccgaggaagtgtcattaaccaaggaccaatggcagggaggcccccaagtgtgggcccagtac

SEQ ID NO: 3379 - DNA, 201 bp, Homo sapiens
taccttaatagccccaaagaagaatgttctgtcttttgaaaacatttttagtggataatatttcttcctgataactaaaagcagattttaaagattgggamcaaaacagaccaataaaaataggaagttaagggaattagagagacctgtgaccttgagtcaccaaaataggctttgtgtgtaggcttctttggtgtcttt

SEQ ID NO: 3380 - DNA, 201 bp, Homo sapiens
ttgtgtgtaggcttctttggtgtctttctcctaagtgtaggccagtctttgtcttccctaaacatgcatctatacatgaaagtagtatttttgtgacaggygatagtgctttttttccttcaaaggtagatcttgttaatttagataagggaaatctgacagaagtgtaatctggtcttaaagttaatacaattcttatgt

SEQ ID NO: 3381 - DNA, 201 bp, Homo sapiens
attagaactctcatcagttatatgttcccaagcatgctttcaggtcagaatatttaaacaaaaatttaagctaaattcccattatagttgtaatgtaaaakcctttctctttgttcccctttcaaagaagaatccaggagaccctcaaggtctaacatgcccagagcctattttggaaatggaggggggatgattatcaca

SEQ ID NO: 3382 - DNA, 201 bp, Homo sapiens
atgacctgtcaaatgcagtctaaaactgtaagttttaaaagggcagtaataatatccttttctcactcttgattagtgttggacccagttgtagtgccaasagatatctttaggcctcatgatctccatcagtatccaaaaatcactccaagattaaaaaaaactggtgtcctgtgatgggtgctactagcattttctcat

SEQ ID NO: 3383 - DNA, 201 bp, Homo sapiens
tagatgtgaggatatggtggtgatcaggccatagttcttgcctgtaagaagtttacattctagtagagggacagtaaggcaataaatacatgagcaaatgyattaaaaagataatgtcaagtactctgaacctgattaaatagagtaaaatgacagacagtaaaggaggagctgctttcggtaggacagctgagaaaggaa

SEQ ID NO: 3384 - DNA, 201 bp, Homo sapiens
tgaaagctgagtgatgagaaggaggcaaagatgtgaagatctgagggaggagttccaggcagaagaaacagtgaatgcagaaccgctgaaatcagaataartttgaaaaaatcaatgggcagagagcaggccagtgtgtcttaagcatgttgaatgaaggagagagtagagcaaaataaataaaaaatcaggggcccatct

SEQ ID NO: 3385 - DNA, 201 bp, Homo sapiens
tagggtaagatgcttggttcatgttccaagggtatcggaagccactatggcatttgagacgagtgaaagtttgatctactcttcagcaatatcattctggytgctctcgggaaggtgagtgggtgaaacaaaggtggagatcatgggaccagtcaggaggctgctgtgttggtccaggagagaaaagatggtggtttgaac

SEQ ID NO: 3386 - DNA, 201 bp, Homo sapiens
tcgggaaggtgagtgggtgaaacaaaggtggagatcatgggaccagtcaggaggctgctgtgttggtccaggagagaaaagatggtggtttgaactacaaycgtgaaagtgcagatggaaagaggaggttgattgggggatatattttggcggtagcacttaagttgaaatggagttttctttgtgaaatatgtagaggaa

SEQ ID NO: 3387 - DNA, 201 bp, Homo sapiens
gaggctgctgtgttggtccaggagagaaaagatggtggtttgaactacaaccgtgaaagtgcagatggaaagaggaggttgattgggggatatattttggyggtagcacttaagttgaaatggagttttctttgtgaaatatgtagaggaaataatttctgggagactagcaagtgggaacaaatggaagaaaaaatgatt

SEQ ID NO: 3388 - DNA, 201 bp, Homo sapiens
ttttggcggtagcacttaagttgaaatggagttttctttgtgaaatatgtagaggaaataatttctgggagactagcaagtgggaacaaatggaagaaaaratgattgctctggtaaaccatacagactcaaatttagaataggtatgtgtgctaagtgcaaaaataaatacagggtattaaaatgagtggcatttgcaga

SEQ ID NO: 3389 - DNA, 201 bp, Homo sapiens
agcagtcttttaccaagtactttcttatacattgaaagtcaatgagtgttcagggattagctagatgcaaagcctaattcagaagtgaaggaatcattacrtataaattaatacaatttgataacactatctatctttctacctctgtttctttttcttttccatatgtcttcactgaaaggtctgttgtaaagttcctgg

SEQ ID NO: 3390 - DNA, 201 bp, Homo sapiens
caattatctgtggacctgtcagagtattgctaccatttgcttagttgtatgttcaacagtatgcagtttataatttaattaattgaacagaaaaagattayagcagtaacaaatcacaaagaatagcaaatgttctattctttgatctagaaatattgtagaaatacagaggagaaaattaataaagacttggaattaagt

SEQ ID NO: 3391 - DNA, 201 bp, Homo sapiens
gtcagagtattgctaccatttgcttagttgtatgttcaacagtatgcagtttataatttaattaattgaacagaaaaagattatagcagtaacaaatcacraagaatagcaaatgttctattctttgatctagaaatattgtagaaatacagaggagaaaattaataaagacttggaattaagtagtaaacaaaacagctt

SEQ ID NO: 3392 - DNA, 201 bp, Homo sapiens
atagcaaaataaccttgttggcctaaattcgccgcccccctctccaaaaaaagaccttttgaaagatgaacatccatttgcactcaaattaactgtgggcwtatctttggagacaggtagatgtgtgagaatatggcaacagtctaggtaagagatgatgaacacaatgcacaatggagaacatgagcaagtaaaatttaa

SEQ ID NO: 3393 - DNA, 201 bp, Homo sapiens
gtagagcacagtgggctgtccttgttgaggagcatgcaggagctatgggcagcatgtagctgggacatgaaacatagacctgggttggatataggaagttwgggaaaaggctttctgaaagggggtgtctattaatgccaaaacaaattactacaaattaagcaccttaaaacaacatccatttattatctcataggtccg

SEQ ID NO: 3394 - DNA, 201 bp, Homo sapiens
tccttcttgaagcacttttcctgtaggtttttgagacatgacactctcctttttttcctcccattttactgactactccttaatcttatattctgactccrcttcctctgcttacctgcaaatgctaaaatatcccaggcctctgtctttaacccccaacccattgatatagtttggaggtttgtccccttcaaatctgat

SEQ ID NO: 3395 - DNA, 201 bp, Homo sapiens
gcctcccaaattgctgggatacaggtgtgagccaccacatatgacccattgttggcttttggtcagtctatttcttcaattaagttgtaagtcctttgagrgaagaaatcctggtttggtcacattttcatcccctaaagtacccagcacagtgtcttaagtcttcttggattgaacggaattgaactgaataaggctaat

SEQ ID NO: 3396 - DNA, 201 bp, Homo sapiens
taagcactaattagttctcactgagacaaaaagacctgcttatggcaaaaatcaaaagccaataagaaagtggcaagggttaaagcatcacttagcatctygagctggtggtgttactgcctgtatgagaggaagtccttaaaacagcaaatggaggtgaaagcagctgtagtttatataatcatgttattcagtgagaga

SEQ ID NO: 3397 - DNA, 201 bp, Homo sapiens
tcatataaataaatgtcccaatgtgttcactggagaacgtgctgctccaagtgggagtcacctcttcattctttttcccattatagtgaaaaacatgcccygatgtttactgatggcctgatgtttacaaggtggtcatctgacttgatgaactgacttgcagaattagaaactctggacagaaagcatggtctcttactg

SEQ ID NO: 3398 - DNA, 201 bp, Homo sapiens
accaccacgctcccaaactatcctgcctgcttacctctctctctcacagaacattttctgtcatgcagcttgtcctctcagtcccctattctctgttatgwagcaacccagagggtggatcatcatataaataaatgtcccaatgtgttcactggagaacgtgctgctccaagtgggagtcacctcttcattctttttccc

SEQ ID NO: 3399 - DNA, 201 bp, Homo sapiens
caatcatagaacagattaatatttgtcaaatgggaatgcataagcagggctgcatcatgactttcactggccccaggcactttttgctgtatgggttcctkccaccatataaaaatattaaaaatttgtaaagttttacaatttagtaggatggagaaaagcaataaagaaaatgaaatggggagggtgatgagaactatg

SEQ ID NO: 3400 - DNA, 201 bp, Homo sapiens
ttagaattaaggaattctttggtatttctcagtgagaaattcttgaaaaccattcatttgaaattcatttaattactctttcgtttcccactctcacgccycacttaataggcaaccattctaatgtatttaatgtacagctttttacattttgcactgaattagaaatagagacaattctaggtatacacctagaattga

SEQ ID NO: 3401 - DNA, 201 bp, Homo sapiens
tgactaaagagacctctgctaggcagtgtctgggaaataatgttctttttaaaaaaagatgggtgaagagaggacctatccttcccttccttccttgttgrtatgtttgatgtcaggacacaccacatgggactgctgcagctattttgggaccatgaagaagaggccaagagaactctagaaaaggcaacccagttatct

SEQ ID NO: 3402 - DNA, 201 bp, Homo sapiens
caattaaactatcttgactatagtctctctgttgtgctatcaaatactgggtcgtattaattctttcaaactatttttttgtacccattaaccatctccasctccccttcaccactccccactacccttcccagcctctggtaaccctccttctactccctatctccatgagttcagttgtataataaaaacccgtcttta

SEQ ID NO: 3403 - DNA, 201 bp, Homo sapiens
gcatgactccaaagtttatattatcaaactctttttgctgcatctcccaaatggcaaaaggtgcaatttatggtagttcagacattctcaggtccacagcktggggatgggggatgggactgattctatgccctttaagaaggtttaacaggtgcaaatttggcaactcttctgcctcttctttctgggaatgaaagacag

SEQ ID NO: 3404 - DNA, 201 bp, Homo sapiens
ttcactaccttatagatgacgggaccccagcttatgaagattaagtgactcccccaagtccatgaactaaaaagtggcagggccatgacttgggccctggyatgactccaaagtttatattatcaaactctttttgctgcatctcccaaatggcaaaaggtgcaatttatggtagttcagacattctcaggtccacagcgt

SEQ ID NO: 3405 - DNA, 201 bp, Homo sapiens
tgttatacacatgagtaaaccttcccatcagccttatgaggtaagtgctattgctatctccattttacagatgacaaaactgtgtacggaagacaggcagktttccccagactctatagctagtaggtagtggaagctagaagttaaagctaggcaccttgaataaaggtttcattctgagctatgacaattctgccttag

SEQ ID NO: 3406 - DNA, 201 bp, Homo sapiens
caatatcaggttgatcttttaactatgaattgtgttggccacagtttttcctcttgagggattttaagacttttccacctcccatgtcactgattatggamtgtgaagtaggatttttaaaattattattttagtagagtcggggtcttactatgttactcaagctggtcttgaactcctggactcaagcaaccttcttga

SEQ ID NO: 3407 - DNA, 201 bp, Homo sapiens
aaaatgaaagtcaaaatatagtagactattcgtacttttccaaaccagaattaaaaccatagctgtttaatttgaacaagaaaagggttttggagactgtrtctaatgaaggtaaataaataaacttggaatgtgggaagctctcaagtctgaatgacaaaaggagtgtttggaaggatgaaaggtcatgagaagcctgaa

SEQ ID NO: 3408 - DNA, 201 bp, Homo sapiens
aatgtcatgcaatatgttcatagaaaaaaaaatctggatgctaagataggcataaggaagaagagagtgaggggtgaaaagaatggatgtagaaagagagycagagaacaattattcttcatgacttcatattgaaaccttgaggattcagatatgcagagatccatacaaccacctctgccatctggccatgtgtagtaa

SEQ ID NO: 3409 - DNA, 201 bp, Homo sapiens
tttgcatatcatctgaaggcaagcatgtttcatgtgtccacattcttcattaaaaaaacaattagatgagttgaaaacagctcacaatacatttgtttacycttactgtagagtaaatgataatctcttgtaacaaattcaaacttctaaaattaaaaatgtcatgcaatatgttcatagaaaaaaaaatctggatgctaa

SEQ ID NO: 3410 - DNA, 201 bp, Homo sapiens
ctgacctaccttcctctggcttggttgatcattacctttgatcaaataaaagaccacatgttccagctgcccttatgccctgcttactgcagtgagagaargaagggagagaaagacagaaaaatagaaagaagacttagacaagatagatattatgtaaatttgcatatcatctgaaggcaagcatgtttcatgtgtcca

SEQ ID NO: 3411 - DNA, 201 bp, Homo sapiens
ataaaataagcaaacaaacagcaaaaagacacgctatggctctttagatgaaaagaaatcagctaagcacacatttccattcacagaatggcagtttctayacatgcatattcaaagcatctttaaatgttcagttcctattgtagctactccatttctgtagatttttttttcttgatggtggcacagatggactcacaa

SEQ ID NO: 3412 - DNA, 201 bp, Homo sapiens
ctaagacactataaaaattttcttcaagtgcagaaagaagcatattagtagagcaaacacctatggaaacctgaaatgaatttcctctcttgtcatttttmttcacaaatgaagaacctttgtcctggaaacgatgattagcatatatctactgcaaagtatatgtgcatgttttggagtttcttggcataaaattgagat

SEQ ID NO: 3413 - DNA, 201 bp, Homo sapiens
gaagtatttctctatttggttgtgtgctttttaattgctatatcggcaatcaagtgacctaatcagttgtgtatcccccctaatgatttggtattccttgyccaaaagcaagccctgttattaaagtgaaacagccacaaaaatcttcataaggtggagatttctacaaaattcaagttatgcacacatctcataaaactt

SEQ ID NO: 3414 - DNA, 201 bp, Homo sapiens
tgagcattattcttccaagccctccctcaaaatccttgaagaagaaaaatgggatagccttggtgattggtgagtgaaagcagaatctacaccagaagtayttctctatttggttgtgtgctttttaattgctatatcggcaatcaagtgacctaatcagttgtgtatcccccctaatgatttggtattccttgcccaaaa

SEQ ID NO: 3415 - DNA, 201 bp, Homo sapiens
acttatccatttatgagcattattcttccaagccctccctcaaaatccttgaagaagaaaaatgggatagccttggtgattggtgagtgaaagcagaatcyacaccagaagtatttctctatttggttgtgtgctttttaattgctatatcggcaatcaagtgacctaatcagttgtgtatcccccctaatgatttggtat

SEQ ID NO: 3416 - DNA, 201 bp, Homo sapiens
acttgctaatatttttcttctcactgccttcccatggcactctctattcacatgctattcaccatctattccatcagattccttggtagcatctgcaacaytacttatccatttatgagcattattcttccaagccctccctcaaaatccttgaagaagaaaaatgggatagccttggtgattggtgagtgaaagcagaat

SEQ ID NO: 3417 - DNA, 201 bp, Homo sapiens
gcatgcttatgaactacagagaaacaactggcagaggaaggcattgaaggtataagagagacagaggtagtggatggggtggcagacaggaagcagtatcyttggttgcatcagcaggacttgctaatatttttcttctcactgccttcccatggcactctctattcacatgctattcaccatctattccatcagattcct

SEQ ID NO: 3418 - DNA, 201 bp, Homo sapiens
aaaagatggttaaggcttcaactcttgtgatgaatttgataggtttaaaatacttaataattgaatgctggggagggaaatggtagtaagagagacaggaragaaaagagctgatctggagactaggtatgtggtgaggccgataattgagtaagaactataggaagtgtagtccttctgtcggagacattctggtgaaga

SEQ ID NO: 3419 - DNA, 201 bp, Homo sapiens
aacctacagaaaaaccaacttgaactggtttttctgaggcaggtcttgtgtttgtgtttgttggtgaagtacaaataactcacgggagaaaaccctatgcracacataaaatctgtatgtattacctggaatcccttaggctattataatttttataataggtgaagatgatactgcaatactgcaggtaaaagatggtta

SEQ ID NO: 3420 - DNA, 201 bp, Homo sapiens
tattaaggagaaaacctacagaaaaaccaacttgaactggtttttctgaggcaggtcttgtgtttgtgtttgttggtgaagtacaaataactcacgggagraaaccctatgcaacacataaaatctgtatgtattacctggaatcccttaggctattataatttttataataggtgaagatgatactgcaatactgcaggt

SEQ ID NO: 3421 - DNA, 201 bp, Homo sapiens
tttgatccactatcaagggcaatgtcacaattcattatttcaagttcagttaatattgatgaggtataaacacatggcttcctcccttgaaattatttctycatgtaaacacacctctcaatagcctagcaacttgtctgccttctgctttcaaagctagatttatcatgcattcccttagataaaaggaatggttcagac

SEQ ID NO: 3422 - DNA, 201 bp, Homo sapiens
caactctattaatatatttctattcatgatgaatgtcagaagaacctgctttttgatagttttagggtagacatagcaaaataaccttgttggcctaaatkcgccgcccccctctccaaaaaaagaccttttgaaagatgaacatccatttgcactcaaattaactgtgggcttatctttggagacaggtagatgtgtgag

SEQ ID NO: 3423 - DNA, 201 bp, Homo sapiens
gtgtacttttggtaacttaaaatatttcataatgatttattaaggtaaaataaaaataagccataagaaaagagatcctattcagtttcaaaaattcaaayataatttacccattgatattagttgaacagtacagcagtaagtggagtaaaatatatgctattgaagttaaggggttatttaagtctcattagcaaacgt

SEQ ID NO: 3424 - DNA, 201 bp, Homo sapiens
agtaagtgttcatccaatggaatactatacttgaggcaaaattaatgaaatctctacatattaggaataaattttgaaaagatcatgttgagtggaagtcmagttcaaaagattaaagtccagtatttatataaatttaaaaataaaaccataaaataaaactattgtttataaacatacatatgtgatgaaaatataaat

SEQ ID NO: 3425 - DNA, 201 bp, Homo sapiens
atataatgataaaggatcaatagagatgaaattgcttataaaaatcaatagctttaatggctttaaatatttcaggacattagcatttgacacaaacaacrttgaaagaaaccttatttaatggacgtttctggctcaattctcagtctctttaatttgtgacaaagtgatattgaaaagctgaggaaataccttgataga

SEQ ID NO: 3426 - DNA, 201 bp, Homo sapiens
ttcaatcagtttctccatcgtatctggagagatctttcttaaatacaaaatacacctctgctcaagattcctcacctgctcctctttgacctcggaacgakgcccactctcgtctgtatgagtctaaggttttttcacttttcctgcctggagctagtattgatcattataatgtatacacttttgaggacttcatctgca

SEQ ID NO: 3427 - DNA, 201 bp, Homo sapiens
cacttacaaaagtgaaaaattaactacccaatatgatacccgctctaaagtaaagagaaaccattgtttttattagttaaaaacaagggtggagttcttaycaatcaatagtcagaataagggtcagagatttacagccttcaagcatctttaaacacactgaggcaaatatgagctttgtgggcagtttgttaatcaagc

SEQ ID NO: 3428 - DNA, 201 bp, Homo sapiens
acttgacctcctttctcaaaatagatgtagagcctccaagtaagatttgggtgagaaacacacttacaaaagtgaaaaattaactacccaatatgataccygctctaaagtaaagagaaaccattgtttttattagttaaaaacaagggtggagttcttatcaatcaatagtcagaataagggtcagagatttacagcctt

SEQ ID NO: 3429 - DNA, 201 bp, Homo sapiens
agagaactaaaggtgaagaggtcgaaaccaagatttttcagtgtgatgtagtgacttgacctcctttctcaaaatagatgtagagcctccaagtaagattygggtgagaaacacacttacaaaagtgaaaaattaactacccaatatgatacccgctctaaagtaaagagaaaccattgtttttattagttaaaaacaagg

SEQ ID NO: 3430 - DNA, 201 bp, Homo sapiens
tacaaatgcagtccattaaaataggacaaaaaaatactgtcaattcttgaaagtcagcctaggtaatgcattttccttccttacccctccaaaaaggagamaagagaagagagagagagagagagagagagagagagagagagagagagaggaggcaagagaaggaggggaggggaataaaaaggaggggagtggagggga

SEQ ID NO: 3431 - DNA, 201 bp, Homo sapiens
tatggcatttgagacgagtgaaagtttgatctactcttcagcaatatcattctggttgctctcgggaaggtgagtgggtgaaacaaaggtggagatcatgrgaccagtcaggaggctgctgtgttggtccaggagagaaaagatggtggtttgaactacaaccgtgaaagtgcagatggaaagaggaggttgattggggga

SEQ ID NO: 3432 - DNA, 201 bp, Homo sapiens
tgcaactggctttgtcaaacagtcagactgacatcaaagctggggcctttgtgagccagcagactggcaagatgagcacagccagaggagaacaatcggtsgctgaggcacagatgatgggttcccgtgctttctctcacatctgatttacttcatcttatcaatgctgataagagcaagaaaactatctgaactggacaa

SEQ ID NO: 3433 - DNA, 201 bp, Homo sapiens
gtgttctgggggaaagtggagaatatttggctgctgcaatgcatcattagtctctccagctacacctaaaaaaatgaatcaataagactttcacatcatayacaattgttacttagctgttgctgataaatttcgtctttctcagggagattttgtaacttggataaatagatgcctgtcattcattccacagttgcctca

SEQ ID NO: 3434 - DNA, 201 bp, Homo sapiens
tttttagtaatttgtatgtgcccagcagtgtgcttttaaaggtaaattactcctcatcttccatcacaggataaaagtgattgtttacctattggtttccyggcataaacatggttttaataatagtttctattaatatggtcatagtaactccataaaaaaaaataaaaaacccttgagtttgtcagaggatcagtaagc

SEQ ID NO: 3435 - DNA, 201 bp, Homo sapiens
tgcttttttcaaacttgtaatttcagacatggtttcaagtttcagcaagttttttattacatatatatgtatatataaatacatttgtacataaaatattyacatatgcacatacataaaatatattatacatatatgtaagcatacatatacatatgtactataatgacatctattttttataaatatctttgaaagata

SEQ ID NO: 3436 - DNA, 201 bp, Homo sapiens
cgagtaaagctgctttcactgcttctccgagttcatgctttctggccaaccgtaataaagggagcatggtttccagcgacgctgtgaagaatgaaagccaygtggagacaacctatctccctctgccatccagtcaacctggaggcctaggccctgctctgcaccagttccctgctgggaacacagacaacatgccgctca

SEQ ID NO: 3437 - DNA, 201 bp, Homo sapiens
tgtttctgacccatctttcctgttctatatgacttgggagacaaatagggttaagttagctttttataaaattgaatgccttctttttccttagaattccygagactcctattttatagttataatgttaactcatgagtagtaactctgcatttggtagctgcatttcaggaaatcttcacattatgaaagagattacaa

SEQ ID NO: 3438 - DNA, 201 bp, Homo sapiens
atctccacctccccttcaccactccccactacccttcccagcctctggtaaccctccttctactccctatctccatgagttcagttgtataataaaaaccygtctttacccagtgctgactaaagagacctctgctaggcagtgtctgggaaataatgttctttttaaaaaaagatgggtgaagagaggacctatccttcc

SEQ ID NO: 3439 - DNA, 201 bp, Homo sapiens
acaatgattgtctctggctatgggccaatctgctcattgaagaaggggaagaatattctcttcgaagggttgtataggtactttggtgagatgatgtatayaaaaacaaattgcctagcactcaggaaatgcttaatgcatagcagctattatcattacattccatcagtgcttggataaattttctttgttaaacaaatg

SEQ ID NO: 3440 - DNA, 201 bp, Homo sapiens
gcaaacaaaatggaaggtcattaaagaagagagctcaagactttctgttaaagtggagtttttttggtgctcgagtaatgcataatctcaccttgaacaaygcatccagttttggtaacatacgtgcattataaaactgttcttacatgaattatataatttgttcctcagtcacagttcctgtcaatttttaaacatgtt

SEQ ID NO: 3441 - DNA, 201 bp, Homo sapiens
acatctattcaggatagggcaacttgcattttgaagacttcactccaaactggattatttagtgctccttatctacatccacatccgcaaatatgcagctmaaaaaaacctagcatcactgtcaagagcaaaggtctgccaacctcacttcccatgggaaacattgcttagtagtttccagattaaatactcaacaatgaa

SEQ ID NO: 3442 - DNA, 201 bp, Homo sapiens
tataggagatccacatgctattcttatgtttatttctcaattaaccaaattataatatgtaacctacaatcagaataccttcaatcatagaacagattaakatttgtcaaatgggaatgcataagcagggctgcatcatgactttcactggccccaggcactttttgctgtatgggttccttccaccatataaaaatatta

SEQ ID NO: 3443 - DNA, 201 bp, Homo sapiens
tttctataggttatttttaagtgtaagattagatttttcatggtcaaggcactaaataaaataggatcttcaaaaaataagtctccatattccccaaatgytaagcctaaactgttttttttttttttttttttttaggaaagtcatgtgaacaagtgcttgttctgaattttcatcagatttacaaagctcaattaaagg

SEQ ID NO: 3444 - DNA, 201 bp, Homo sapiens; identical to SEQ ID NO: 2711

SEQ ID NO: 3445 - DNA, 201 bp, Homo sapiens; identical to SEQ ID NO: 2712

SEQ ID NO: 3446 - DNA, 201 bp, Homo sapiens
gcagcctctgcctgggctacttagctgcagttcaaactcaggtgtgagtggcaaggggaattcagggtcaagtgtgtaaaataagcagttccttgctgggwaaagtgagcgctactgacagaaaccagaataagcctgagttgtgtggagcttcaccccttacagagcgtgttagttttactgagcgcattagcgtcttcc

SEQ ID NO: 3447 - DNA, 201 bp, Homo sapiens
cctataaaatggtgaaaacaatacctgcctcactcctgggaggatgaaaagagacaatgcatataaagcactcagcagagtgcctgccccacagtaactgkcaagtagtgttgttattaagtggctcttaggatacttattgttcctgagacccaaggacagctctttgcttgaggggctgtctgggaggcccttagatct

SEQ ID NO: 3448 - DNA, 201 bp, Homo sapiens; identical to SEQ ID NO: 1705

SEQ ID NO: 3449 - DNA, 201 bp, Homo sapiens
gtcgaggacctccatgtaggtgccacggtggcccccagcagcagaagggactttacctttgacctctacagggccttggcttccgctgcccccagccagarcatcttcttctcccctgtgagcatctccatgagcctggccatgctctccctgggggctgggtccagcacaaagatgcagatcctggagggcctgggcctc

SEQ ID NO: 3450 - DNA, 201 bp, Homo sapiens
agctgagcctcggcaatgcccttttcaccgacctggtggtagacctgcaggacaccttcgtaagtgccatgaagacgctgtacctggcagacactttcccyaccaactttagggactctgcaggggccatgaagcagatcaatgattatgtggcaaagcaaacgaagggcaagattgtggacttgcttaagaacctcgata

SEQ ID NO: 3451 - DNA, 201 bp, Homo sapiens
tttaggatattaaaaaccatgaatacaatggcaaataataattttatgaaaatgggaaactttaccatctgtttttctttctacccaggtacttatcatcyctgcacaagcctttgcatcttgaaaatccaccagttttatagcactctgaaaaaattccttgttgccatggagatactgttctttcacagtgaatccttc

SEQ ID NO: 3452 - DNA, 201 bp, Homo sapiens
cagaaagcacaaagtaatgctgaactaaacaacctgatgaatagtcctataagaactggatcttctgatttgtggtgaaatcatttaaggagaataaaagygatatgttaattaaataaattcaaatgatttttacaccaaagtaaattgaaatgccattccatactctactaaacattcataggcaatgttattgcatac

SEQ ID NO: 3453 - DNA, 201 bp, Homo sapiens
ctgggttgccaataacttgcttcccagataaatggttggaggaaagagggaacagaaattgcatttttttttgaagtaacaattacccaacaaaactcggygagaattctaagttctatctaaggtctcaattgcttggcttctttctaacaagtctaaaatttccctcttatgtattcaagatttttacaccatcaaaga

SEQ ID NO: 3454 - DNA, 201 bp, Homo sapiens
agaaatcattcaccctaccagttgatgttgcagcttcactaccatcttcatttatctcaaagaaaactttttgcgtcacttgggaaacatacacttcagawgaatctggttaaaaaaaaatacacaaaagtgtatttaagagttaaaatcaaaagccgttacctattagatctcaattaattacatttatttatttattta

SEQ ID NO: 3455 - DNA, 201 bp, Homo sapiens
acaaaacagcaagaattcacagccctcttgttttctagtaagttgagcctggaacccccaaacaacctatttcttcttaacccatatctagttagtcacasatttcaataatttcaccagttccttactattcccagtgaggctgctccctttaaacactctttacttaatgtccgagttgttgcagtggttttttaactg

SEQ ID NO: 3456 - DNA, 201 bp, Homo sapiens
ttttatattctgtatttggttttgatcgtagtttaaaataaaatgtacttgccttcaaatctggggaagctatgaaattctaaggaacttctgtgtcaccwgttacaaaatcacttcagagatacactttaaaacctgttaaaattttcagcataagatcgtgctttacaacgttttgttctggtgtggatatgagctgag

SEQ ID NO: 3457 - DNA, 201 bp, Homo sapiens
gcacaacaggattcatcttccagaactttccacacatttggacactattctcccttttggggtcaggtagattaagttaaaaccttcctacacagaacttyggatatttgaagcttctgtttacctccaactcttgtcttttcagagtaaatgttcccagctccccacatagtgaacatgttcttctcaccaccaccaggg

SEQ ID NO: 3458 - DNA, 201 bp, Homo sapiens
atacatcgtgatcctgccaagtagagaaggtggcctgctgacatatctgcaaactaaataccagaaagttaacccgattttccttctccttcttttttctrttggatagtcagcaggtgtaatagcgtagtctaaaaggagcgacccacggggtctttctccttgccgcagctgcaggcttcttattttcttaaaaaagca

SEQ ID NO: 3459 - DNA, 201 bp, Homo sapiens
cacatgggcagtgagcaactcagggaaagaaaccacagagaggaggggtagacaccctacggtttgagtccaggtatcttgggaaattgtcacttcttttrtgggggtgcttacatattcagaagcatgactggagtgtaatctgatcatttaatccatataacctggtaatatattataattaatgtcagaagtatttct

SEQ ID NO: 3460 - DNA, 201 bp, Homo sapiens; identical to SEQ ID NO: 2778

SEQ ID NO: 3461 - DNA, 201 bp, Homo sapiens; identical to SEQ ID NO: 2779

SEQ ID NO: 3462 - DNA, 201 bp, Homo sapiens; identical to SEQ ID NO: 2780

SEQ ID NO: 3463 - DNA, 201 bp, Homo sapiens; identical to SEQ ID NO: 2781

SEQ ID NO: 3464 - DNA, 201 bp, Homo sapiens
gaaaataactctgcaaaaaattaactgtatgaaaaggaggactgtaacccttccagtttaaatcacttagtaaggaaaataagtcagaaacttggatcatktctagcaaataaaagtaatgaattatgtatctattactatgtaagagcactaaaaagtatagccaggattttagttaaaattcaggtgttcattaaattc

SEQ ID NO: 3465 - DNA, 201 bp, Homo sapiens
ttaatgtgtctctcctgatttaatgcgtcatctttaaagaatcatcctcaattctgcagcaataaaaataaaaaccttccctttcaccttgcaagcctccygcagaaagccccaggaagagccttgtcagggcagctgaggagacaattaataaccatgggtgatggatgaggtgcacgtggcctgtgcctccacttttat

SEQ ID NO: 3466 - DNA, 201 bp, Homo sapiens
gccctaatgtatccgtgtcaccagggcaagttctaatacctcttgtaacagggccattatccctaagtcagagagctgatggatgagatcgcataggactrttactgagcacagtggcttcaatagttggaagttattcacggagacactttcaccctctctattcctcccttgttttcttcctcggtgcaccccatccat

SEQ ID NO: 3467 - DNA, 201 bp, Homo sapiens; identical to SEQ ID NO: 2782

SEQ ID NO: 3468 - DNA, 201 bp, Homo sapiens; identical to SEQ ID NO: 2783

SEQ ID NO: 3469 - DNA, 201 bp, Homo sapiens
caatggaacgtaggcttttgggtcatttgttaagcaggatgattttagaaatcaatatctggtctattgaggtctatgcaacctgcttggctaaggtgacrtctacctgagacaaaaatgatagaaataggttgtctcacagtgacgggtgccatctgtcctctacgcagctaagatggaaaagcagtgggagcaaagggg

SEQ ID NO: 3470 - DNA, 201 bp, Homo sapiens; identical to SEQ ID NO: 2786

SEQ ID NO: 3471 - DNA, 201 bp, Homo sapiens; identical to SEQ ID NO: 2788

SEQ ID NO: 3472 - DNA, 201 bp, Homo sapiens
catccttgcaccatggtgggaggggtatcattgtcctggcttcatagaagagagacctgaggaccttccagggtcccacgccatttatgtagccaaactgrattcaaatccgggggccttgattgtaagtcagtccactttcctccataaagtgctcaaaatccttcaagcaagtccatgaaacatagtactcagatctct

SEQ ID NO: 3473 - DNA, 201 bp, Homo sapiens
actgataaatttgccttaaatataaagagtcaaagccttggccagttgtggtggttcatgcctgtaatcccaggagtctgaggccagcctaggcagcattktgagactccaactatacaaaaatattttaaaatttttaaaaaattggccgagtgtggtgatgcatgcctgtagtcctatctactcagaaggttgaaccca

SEQ ID NO: 3474 - DNA, 201 bp, Homo sapiens
agaattatgaaactaagaaggcaaacgaatctggtctgtcccctcatttaacagaagagccaactgaaccctgcgaagatcatgatttatcttggttcctracacacagagctggacacgctgtgtctggttttatggccattcataaaacccagaagtcatgtgctgaccaccaaggttgaagactggcatcaaagtgat

SEQ ID NO: 3475 - DNA, 201 bp, Homo sapiens; identical to SEQ ID NO: 2777

SEQ ID NO: 3476 - DNA, 201 bp, Homo sapiens
tgaccaccatactttttctgtgggcttagggcacacagaatatttagggacacgagcctagatgccagggatatcccctgatttgattggagtccaggaawcctttgggagagaactcgaactctgactgtacttggggttcagacatgccaatctgagggataaactggagctgggagcagtgggaacctgtggggggct

SEQ ID NO: 3477 - DNA, 201 bp, Homo sapiens
caagtcaccgttcaaagttgaataaatagtgaacacaatataacattaatgcagattaattaccatggcccagagaccagccatgagacataacatgcttygctgtcaacaacattcaggattggaattccagagatggcgtgtgctactggcttatggctgatacgtaagagaatctcatctatctctaaatgttctgcc

SEQ ID NO: 3478 - DNA, 201 bp, Homo sapiens
agtagacagtgataaggatttatattgcaatccctacaggaacaactagaagaataatgacagacatgcagctgaaaatccagtgaaggaactgatgaacrctgagttgtgccttctagatccctctaaggaaagacttgttgacctagcagcagggactgttgttggctgatgtcttctactgtcagacccttcagtaat

SEQ ID NO: 3479 - DNA, 201 bp, Homo sapiens
ctgttgtctcagcacatagcacgctagcatggggccacatgttgcattggtcaaatctcaaggagtgtctgtaatgagccaatacaaacagatgaagcctytacatggaaactctctgctctagactcacgtttggccagggggcgtggcctggagggtgtaactcagggaactccacaggaatagtcccggctgggaact

SEQ ID NO: 3480 - DNA, 201 bp, Homo sapiens
aactttcccacatcttcctgttttcttctgagccctctaaacttccaaactctgccttttacccagtttcaaagttgcttccaaattttcggatatctttrcagcattgtcccactcctggtaccaatttactatattagcctgttctcatactgctaataaagacatacctgagactgtgtaatttataaagaaaaagag

SEQ ID NO: 3481 - DNA, 201 bp, Homo sapiens; identical to SEQ ID NO: 2778

SEQ ID NO: 3482 - DNA, 201 bp, Homo sapiens
gattcaagaggccagtagatcaaggtgtgggcagaggttgacaactgttctacccagtgaggcacaggcaatgtgttagctgtgggttggctgtcatcacygggtcagggatctgatgggttttggatgtcccattgcaggcagagccacagtgaagtctcttccctctctctcagcctgagggactgaagctcccccttc

SEQ ID NO: 3483 - DNA, 201 bp, Homo sapiens; identical to SEQ ID NO: 2779

SEQ ID NO: 3484 - DNA, 201 bp, Homo sapiens; identical to SEQ ID NO: 2780

SEQ ID NO: 3485 - DNA, 201 bp, Homo sapiens
tcgcacagtggatggctctatgctatgtgctccagggataaaacccatggcaggacagccaggcgatgtgtgtatgtgtttgggatctttctgtaacgccrtgtgctgctgtgttcgcacagtggatggctctatgctaagtgctccagggataaaaccccctggcaggacagccaggcaatgtgtatgtgtgttcagggt

SEQ ID NO: 3486 - DNA, 201 bp, Homo sapiens
cactggagtgggccttaagctttagtctgcaggggctttctgggcactgagatggtcctggggcttggatacattggggtgtgcctggtgtattggtccaytggggccagcctggagggtgggttcatgagggctaacctagatcctcgggctgtagaggctggtttgaaacttaggtccacaagggatgaggtctggggg

SEQ ID NO: 3487 - DNA, 201 bp, Homo sapiens; identical to SEQ ID NO: 2781

SEQ ID NO: 3488 - DNA, 201 bp, Homo sapiens
acccaggtgaaccctggaggatgacagtagactaccaccaactcaagcaagtagtagcaagccttgccctcaccctgcagaatatgatatatttagaagargtcaacacagccttaggggcatggcatgtggctattgatttggcaaatacgttttttcacatcctttgcagaaaagaggatgagaaaccatttgcactca

SEQ ID NO: 3489 - DNA, 201 bp, Homo sapiens
ctattatggatatcctatagaaatgaagtcatacaaaatgtggcattttgtgtctggcttctatcacttagcataatgttttataggttcatgcatgttgytgcatgtgtgaggtcactaaaacttgtacctatgttttcttctaagaatttatagtttcagctctaatatttgggtctttgacccactttgcattgattt

SEQ ID NO: 3490 - DNA, 201 bp, Homo sapiens
aagactaagaagtgaagtctaatggcttcacttctctagtgggaaactgagatagtataatgaagagatgtgctgaaatgtggatgacatgatacatcagkcatttcaaagaaaagtataacaaagacttgagattgattaacaagcaagtggaaaccttggtagcatacaaagactttcccatctgcagcatgagaaaag

SEQ ID NO: 3491 - DNA, 201 bp, Homo sapiens; identical to SEQ ID NO: 2782

SEQ ID NO: 3492 - DNA, 201 bp, Homo sapiens
acttttagaaagctgaaaatttgtgccaatgatttttttcctagcttatttttggctttttgattctaaggagttttgacctacaaagatgctcaatattyaaatagacagatatttttgttttatttcttccattgcttttatacttcggcatcctccttactgagatgagataaagttttcaaaaacattgtatggaat

SEQ ID NO: 3493 - DNA, 201 bp, Homo sapiens
tagatattcaacaatgctgtaagtaactggtagaatttccataccaggtctcttcctatgtcactagcccatgggcacaagaggtcatgaaagaggaacaraaataggaaaacctgcatcaacacagaaacagcctgttctttgccagaatggagaacaaggcaaagctggtacttttagaaagctgaaaatttgtgccaa

SEQ ID NO: 3494 - DNA, 201 bp, Homo sapiens
tgtaatttaaagttgggtcttgctgccttttggggcttcgtgccgggcacctgaaggaaagacaaattaaattattctccaacgtgctctggatggtgagsctcaaacctgaatattttgtgttttgaaatttgagttttcagagtcagaaatttagagtatatccatacagatatcctagaataaaacatatacttctta

SEQ ID NO: 3495 - DNA, 201 bp, Homo sapiens
tcctccaattttcttcctttttaaacattgtcttggctatttggtgtcacttgttcattttagaatcaatttgtccatttctgaaaaaaaaaaagccactrgaattttggcaggaattgcatggaatctgttgatcggtttggcatatattgccatcttgatattattaagttttccaatccatgaaattacacatctttc

SEQ ID NO: 3496 - DNA, 201 bp, Homo sapiens; identical to SEQ ID NO: 2783

SEQ ID NO: 3497 - DNA, 201 bp, Homo sapiens; identical to SEQ ID NO: 2784

SEQ ID NO: 3498 - DNA, 201 bp, Homo sapiens; identical to SEQ ID NO: 2785

SEQ ID NO: 3499 - DNA, 201 bp, Homo sapiens
acttcaagagaacactatttccaggccacaaggaatgcattggtacatgcagttgccacagtaaacggcaaggttgtagggacagtcggggacctgattayctgagagttagacccctaatagattatggcatgtttaggggcaaaataaatgagctgccaacaaggttactactcaatctgtacaaaaaacaaaacaaaa

SEQ ID NO: 3500 - DNA, 201 bp, Homo sapiens
cttcaaaggcctcagaaagggtctaccttagaaaatagccagcttgaaagacttccatctattctgggcagaggctatttctagaaaacgattgccccgayagccgatctctaagagagccctttatctaagaggtgtcatctggttggattctgaaatcatctagtagggtttaaggtggtgcattaatcagaggagttt

SEQ ID NO: 3501 - DNA, 201 bp, Homo sapiens; identical to SEQ ID NO: 2786

SEQ ID NO: 3502 - DNA, 201 bp, Homo sapiens
caatttcctagtattttgttgatgatttttgcatccatgttcatcagggatattggactctaattttcttttcttatagtgttcttttctgtttttggtawcagggtaattctagcctcataaaatgaatttgaaagtattcccttttttattttttggaaaagtttgaggaggatttctcttattagttctttaaacgtt

SEQ ID NO: 3503 - DNA, 201 bp, Homo sapiens
gtagtctcttatgatcatttgtacttcttcagtatctattatagtgttttctctttcatttatgattttgtttgagtattctgtttttcttagtttagatraagtttgtccattttaattatctttttaaaaattatttcttagttttgtttctcttttttatcatttttctagtttcttgttcttctgtttctgctgtga

SEQ ID NO: 3504 - DNA, 201 bp, Homo sapiens; identical to SEQ ID NO: 2787

SEQ ID NO: 3505 - DNA, 201 bp, Homo sapiens; identical to SEQ ID NO: 2788

SEQ ID NO: 3506 - DNA, 201 bp, Homo sapiens
ataaaaaaaatataatgtctgaccattttggcccaactgaggtcaactctgaaaagccactgtagctccagaggtctctgtgggtcttcaggtgttactgktgggcccctgttacagctcaacttctctctctgccccattctccttccttttcctttctccctccttcaggcattaatctcaaggacactcttgaacaag

SEQ ID NO: 3507 - DNA, 201 bp, Homo sapiens
tactttggctatttggggtctattgctttccatatggattttaggattttttttctatttctgtgaaaaattttactggaattttgataggaattgcatcragtcaatagacggctttgggtagtataaacattttaactttcagtataaacattcttaacaaatttagtataaatgaatgtacctcagtgcaataaaggt

SEQ ID NO: 3508 - DNA, 201 bp, Homo sapiens
gagctcaactaatgcttggatgaagaaagaaaggatggaaggaaggcgggggagggaagtgagggtacaggtggcatctctcttttagacaggagaaaacrggctcagggaaaaagtgatttgtccaatgtaacacaagggattgatggcaggaatgtgtatgggggtggggggctttgggctcctggcccaggtctcttg

SEQ ID NO: 3509 - DNA, 201 bp, Homo sapiens
tcagggatttactgaatgcccatattgcttttttttttgttcacctgttgctagaccatgaggtgaaggtctccaaggacaggggctgtgacatattcatyggtgtgtgctcagttcccagcactatgcctagaagagggtagttttcagtaaaggcatgagtgaataactgaataaacctctagcataaaaataaatata

SEQ ID NO: 3510 - DNA, 201 bp, Homo sapiens
atgaaacactgccagggatacaagtaatgaccttgccagaaggaggtcttgaacaatcgtgtcaagatagtggcatggtgaggacagggtaagtggacacrgtggggtaatgagggcaaggggagaagtggtagttgcaggaagatgtgctttcttccttcttcttttctttcttttcagttctttccttcattcctcctt

SEQ ID NO: 3511 - DNA, 201 bp, Homo sapiens
cctaatagattatggcatgtttaggggcaaaataaatgagctgccaacaaggttactactcaatctgtacaaaaaacaaaacaaaacaaagaacaaaacamggatagatgatcaggaggttgacagcaattgccctcgtacagtgttatgattccttgagcagttactgaatcaatgccatttttattttattttattttt

SEQ ID NO: 3512 - DNA, 201 bp, Homo sapiens
ttcaggtgaatgaaaatagaatcagtcaccagcagattcacattataaggaatagcaaaaaaagttattcaggctgaaaaaaatcgactccaaatgtaatwgtagaagtacaggaacaagcaaggagcatcagaaatagtaagtatatggcacatatgaagattacacagttttttatttctcttaatttttaaaaagaca

SEQ ID NO: 3513 - DNA, 201 bp, Homo sapiens; identical to SEQ ID NO: 2325

SEQ ID NO: 3514 - DNA, 201 bp, Homo sapiens; identical to SEQ ID NO: 2326

SEQ ID NO: 3515 - DNA, 201 bp, Homo sapiens
gagaggctgaaggagtgggttttctcgaccagcagtgggacgcagaggacctgcggtactggcggcctgtgtaatctgcctgttaggtgtgttgctttaaytgagtgaatacaaaattacaataattatacacagcaaaaggcacttgatagacaatccaatttgctccttggtcccaaataccgacagaaaatggcgtaa

SEQ ID NO: 3516 - DNA, 201 bp, Homo sapiens
tcaccctacctgcctcacagagaactgtctaactatcaggagtcaagtacttagttcagcccttaccaagggtagctcttaatacaccaagctgtggctcrgaatctgccccgcctcgtggaatccttcaggaacctcctttctttggctcagccctccttattacctcacacagccttccttattagcccacggagctac

SEQ ID NO: 3517 - DNA, 201 bp, Homo sapiens
ctgcactctagcctgggtgacggtgagacctgcctaaaaaaacgaaacaaaacaaaaccaaaccaagaacaaaataaacctacaccgattttttaaaggaraaaataagctatgtgttaagtattccccaaactcactgcttcttccccaaatgccacccatattcctcaaatctgcctacacctgtctagaagtcatggg

SEQ ID NO: 3518 - DNA, 201 bp, Homo sapiens
agctgcctcaagaaaaaaagctgacaagcagtaaggatggagccaggctggtcagggaggccccagcccagccccacaacctctctggctcatggggaacragctgttaaatctggggcgggaagagcagctagaagtcttccctctgacttggagctaggggttggaatgatgaggaccaggaatcttggcccaggcctg

SEQ ID NO: 3519 - DNA, 201 bp, Homo sapiens
caaggtggtttaattcttcccaagtctccccttgtcacaaacttgtcctcgtcagcaaagagaggcctttcctgctgcagcagctttctggcaggaggaaygtccgctccctctgctggctcctgcttcccgctggagagcagggcaggaaatggacagcatttggctcagcttttgggaactgccccagttgctgccagg

SEQ ID NO: 3520 - DNA, 201 bp, Homo sapiens
gaagcgcccctgggggactctggagaccagtccctggataagcagaggtggcacaagcttgctcttggcgcagctgcctcaagaaaaaaagctgacaagcrgtaaggatggagccaggctggtcagggaggccccagcccagccccacaacctctctggctcatggggaacaagctgttaaatctggggcgggaagagcag

SEQ ID NO: 3521 - DNA, 201 bp, Homo sapiens; identical to SEQ ID NO: 3119

SEQ ID NO: 3522 - DNA, 201 bp, Homo sapiens; identical to SEQ ID NO: 1421

SEQ ID NO: 3523 - DNA, 201 bp, Homo sapiens; identical to SEQ ID NO: 1422

SEQ ID NO: 3524 - DNA, 201 bp, Homo sapiens; identical to SEQ ID NO: 1423

SEQ ID NO: 3525 - DNA, 201 bp, Homo sapiens; identical to SEQ ID NO: 1425

SEQ ID NO: 3526 - DNA, 201 bp, Homo sapiens; identical to SEQ ID NO: 1426

SEQ ID NO: 3527 - DNA, 201 bp, Homo sapiens; identical to SEQ ID NO: 1427

SEQ ID NO: 3528 - DNA, 201 bp, Homo sapiens; identical to SEQ ID NO: 2218

SEQ ID NO: 3529 - DNA, 201 bp, Homo sapiens; identical to SEQ ID NO: 2219

SEQ ID NO: 3530 - DNA, 201 bp, Homo sapiens; identical to SEQ ID NO: 2220

SEQ ID NO: 3531 - DNA, 201 bp, Homo sapiens; identical to SEQ ID NO: 2221

SEQ ID NO: 3532 - DNA, 201 bp, Homo sapiens; identical to SEQ ID NO: 2222

SEQ ID NO: 3533 - DNA, 201 bp, Homo sapiens; identical to SEQ ID NO: 2223

SEQ ID NO: 3534 - DNA, 201 bp, Homo sapiens
agaataaagacaaataaggcatagattttacctttacagacctgacagttccaaacctttaaacaaagaagggattatcagaccccattttacaataaagscatgacgccagagaagataaaagactcttatgtaatgggatgaaaatagaatccaggtttttctggataaagagtcctttatagtaccaatactttcttt

SEQ ID NO: 3535 - DNA, 201 bp, Homo sapiens
tgtgggtttgacctactgacttctttcaaaaaaatacaatggggagtggcggggcaggagtagctttacagtagagaaaactgacaaatactacctcaggygcctgttgatcaagatcaacatcaacaatcagttgagttgataatatgtacccttgacatgatgtaatataagggtcactttatctctatggacttcctc

SEQ ID NO: 3536 - DNA, 201 bp, Homo sapiens
gagacaaaaataacagggagagctaaagagaacttcaaaaactttttaaaaagctaatattttctcagaaagaaagattttacattcatgaaaaagaacayagacattataaaaatgtcccgaattttatggaagttttgaaaaataaagttaagaaaatttgttagaaattataaccatctacaaagtcaaaggactagg

SEQ ID NO: 3537 - DNA, 201 bp, Homo sapiens
tctaaaatggcagctgtgccataaaaaaaaaatgctggagggtaaggtttactgcatcagctacttgagatggaatgtttctccctttctaaaatgaagcrtgagtgtgttttaaccacttctcctcattagcatgacctagggagcttgttaaaaatacatagttcattgcccaaacctgagcctgaatccctaaggcca

SEQ ID NO: 3538 - DNA, 201 bp, Homo sapiens
tcataccaacaccactcacctcctacatatctgatttgagcttcattagctaccgtttattcgacagatctcatcctccctagaatatgccaaatttccaktgactctaatggaccagaaagacaccatttgttccaagtgaacttcgaaatgacctcataatatataaaggtcaagtattttataaaataatagctggtt

SEQ ID NO: 3539 - DNA, 201 bp, Homo sapiens
acttgcctacttcaaaccacggcactttatttcaaattcaatcttcccactcactgtgaaagcaactctaacctcttcaccaccatccactgatcccattrtccattaaccactgaatctctccttccgcaggcatgaggcccttcgtgtgcttacctctctgtagattcaggcgcacgtttatctttacatcgttgaacc

SEQ ID NO: 3540 - DNA, 201 bp, Homo sapiens
gagtgagactctgtctcgaaaaaacccaaaaatattttgaaaaacaaaagaaaaaagaaaaggcacctatgaaaaaaaaaacaaaataaaacaaaaaacasctcaccaggtgctgcctccttcaagcaggattagaaaattcccctcaaccagtgtcttgctagtagcaggacatgtagacatagacccctgcaactttca

SEQ ID NO: 3541 - DNA, 201 bp, Homo sapiens
aaaacacaagacacagaggtgaggagagttcctgaaacacgctcctggggctaaggagagggataagacgtccaggcctgcgggaggtgctggggggttasagacagcagcaaggtgcgagacgggcaaggggcatggtgatcccagcccccggcatggcgtctcctcctccaggctgagagatgatgcccagcctcctcc

SEQ ID NO: 3542 - DNA, 201 bp, Homo sapiens
tgcccaccttggcctcccaaaatgctgggattataaatgcgagccaccacgcccagccaggttacagatgtttaactttgattctttacctctgaagtcarataaacctgggtgtgaattcttttgtcctgccacttgcttgcttgactttgagcaatttacctttttctcatgttcagttttctcagttgtaaaataggc

SEQ ID NO: 3543 - DNA, 201 bp, Homo sapiens
ctctgaaatgctgctgtaactttttcagtaccatccagatattataatactgaatgagcccctactcctgccagtcactgtgggggatacaaagatgaacragattcaatttctgcatttaggggtctagtggacctgaaactgttagactttactctgcaatctgtgtcgggattcctgagactgagggagggaatgtat

SEQ ID NO: 3544 - DNA, 201 bp, Homo sapiens
cgtacacacacacacgcccctaaacaatagattaattttgttggcaattttttactatagtgaaaaacgcataccaaaatttactgtctgtaccatttgtraatgtacagttcagtagtgttaagtatattcaagttgttgtaaaacattgttttttgagctatataaaaatggtatcacactctacaaatccttctgggg

SEQ ID NO: 3545 - DNA, 201 bp, Homo sapiens
agtaggtctgggatctagttgtgttgattctggtgacctatcacaaacccctctctaagcttattgctttttgctgttaaacttggtcataagcaagctgygtccattgtgaagtgtgtgctgtgagcacatcgcatacactagatttaatcatccactgccggcactcagtgcattgtgaagggagggtaaggagctggt

SEQ ID NO: 3546 - DNA, 201 bp, Homo sapiens
aatattttgttctagctattttctcacccgctgatatttgtttaacctgaaaggcgaattcttataagatcttgtttctcagagtgaccctcaggtggacyggtgataccaaagtttaggtggcaattcactttctccattttttgaagactgaaaacaggggcagcaattccattatttctgagagaaatgaaaacatat

SEQ ID NO: 3547 - DNA, 201 bp, Homo sapiens
gtacaactggtgcttcaaacagtacgtccctatttggactgaagacattgtttcctatcccggccagcttctagtgataactccagtctgcactatcaatmttttccagcctctacaggctgtttctttcagataaggaatttccctttataaacctgtcagctgacaatgactatgctttgttttgtttctcatttgttt

SEQ ID NO: 3548 - DNA, 201 bp, Homo sapiens
ggagagcaatgccttacatcaggaatacaaccaaaatgtctaagtccggagactcgaggcaaagtgggaaacgttactcacagtgctttttatccagaggygtggacttagttactccaaaggagtccagaagcataacacttctggagaggcatctactggacttgtttttccacgaaacttctagacttgttttgatca

SEQ ID NO: 3549 - DNA, 201 bp, Homo sapiens
atttcaactttgcaacatgtactgttgtgtttctgagttgttgactatttcagttccaaacagttcgttatttcctgtcagaggaaacttcagagtaacartaaagtgctggtgtggcttcaaaggcttggagaaatgaaaagcagtggagaaattttgtgaggttcctttggcttagaaggttcagaaaggctttgagcg

SEQ ID NO: 3550 - DNA, 201 bp, Homo sapiens
tgaaaaatgaggcaaaagaaaccaggaattgagatgtgtgtgtgcctgtaccagcacccgtgtgagccccttgcaggtaacgacccatggtccctgcacaycagtcttctgttactaagttttgcataaattgagtctggtggttggcaagctacatatagccagctgcgtgtttgttgttttttctgcctgctagctaag

SEQ ID NO: 3551 - DNA, 201 bp, Homo sapiens
tgatcctctcaccttggtctcccaaagtgctgtgattacaggtgtggccaccatgcccggtgggtttggattccatctgcttgaggacaaccatgggcaarctgctttctctgaagcatagtttcttcacgtataaagcaggggcaagaatactgactatatagtcactacattgaatgacttagtatagtatatgaaaag

SEQ ID NO: 3552 - DNA, 201 bp, Homo sapiens
ggagaggcaaggttcttcagtggaaaggatataagctttctagtcacaccagcctgagttagaatctgtcctctgccactttttacttgtatgacctcaaycaacttactttacttctgacttcagtgtcctttctgtaaaatgagtctattaataatgatattgataatagctaaaattgagcatgtactatgtgccagg

SEQ ID NO: 3553 - DNA, 201 bp, Homo sapiens
gtggcatatgcctgtggtcccaactacttggagactgaggcaggcaggaggatcgcttgagcccaggagttggaggctacagtgagttctgattgtcctgygaataggaatagccactgcagtccagcctgagcaccacagtggagactccactttttttttttttttaagtttaaaaaagttaaaaaaaaaaaaagacaa

SEQ ID NO: 3554 - DNA, 201 bp, Homo sapiens
tggtgaggaaggagctatttaagtcagaactctcagagtgacaaactcaactaaaattaaatttcacaaaagtcaatttattagctttcataaacgataaytgtaatctcctagggtgacagtggcctccggcatagctggatccagaagctcgagtgatgtcatgacatttttcttggtactgtttttctcaactattgt

SEQ ID NO: 3555 - DNA, 201 bp, Homo sapiens
aaagtgcaaaagctgccttggcttgttgaagccttgacctcacaggctcaggtgattctcccacctcagcctcccaagtatctgggactatggatgtgcaycaccatgaccagctatttttttctatttctagtaaagacagggttttgccatgttgtccaggctggtcttgagctgctggactcaagcaatctgcctgca

SEQ ID NO: 3556 - DNA, 201 bp, Homo sapiens
agggagaggagcaaagtttgaaaaactacttcttgggtactgtgttcggtacttgagtgacaggatcattagaagcccaaacctcagcatcagacaatacmcatatataacaaacctgcacatgtactcctgaatctaaaataaaaataaaattaaaaaggattggctagcactgggaagagcagtcttttcccgcccagc

SEQ ID NO: 3557 - DNA, 201 bp, Homo sapiens
ataagttcctcataggaagagttttcctttgaccctcagaactgtgagcttcaagctttgtcttctatgaaaattaaagacattcccgaatttaatgtttrttgaattaatccaggtagaaaaaaatgtctctgggccagtgcccaggtacccagacttccagatcagtaatcacaatttcctcatttgaggggttttgtc

SEQ ID NO: 3558 - DNA, 201 bp, Homo sapiens
gcgagagtctgtcaaaaaaaaaaaaaaaaagaagaagaagaagaatgtctgcgtgaaaatttgttctgttctttgagatactagaaacgtagatgccaacrtgttgggtttaatggcaaaaaccgcaattactgttgcaccaacctaaaataattgaaaagtggcaacttagagcagctttgttctttctacataatatca

SEQ ID NO: 3559 - DNA, 201 bp, Homo sapiens
ctcaaacattattttccccgtcacctccctgatgggaggtgcttctcaaacgttaatgtgcatattaatcacataggggctctagttagaatgcatatttktatcagtaggtccaagttagggcttgagattctgtatttttaacaggctcccaggggttggctacgtaatacccaaagggtggggttcttgcctttattc

SEQ ID NO: 3560 - DNA, 201 bp, Homo sapiens
aatcacataggggctctagttagaatgcatatttttatcagtaggtccaagttagggcttgagattctgtatttttaacaggctcccaggggttggctacrtaatacccaaagggtggggttcttgcctttattctccaattctaataggaaaggcatgtgtttgaagctcaggactccgtatgtaggctcactggcttta

SEQ ID NO: 3561 - DNA, 201 bp, Homo sapiens
gtatttttaacaggctcccaggggttggctacgtaatacccaaagggtggggttcttgcctttattctccaattctaataggaaaggcatgtgtttgaagytcaggactccgtatgtaggctcactggctttatgggattaaccaggctcattgctaggtggtactaatgtgtccctcttttctgtgggaaccatcatctg

SEQ ID NO: 3562 - DNA, 201 bp, Homo sapiens
taaccaggctcattgctaggtggtactaatgtgtccctcttttctgtgggaaccatcatctgatggtgccccaggtctgggagggaacgattgaccttgtrtgtttcctatggggccaaccttgatggtgacatttagctgagcagctctaataattgttttttcaacctgcctttttgacaaagccgtttatgattatct

SEQ ID NO: 3563 - DNA, 201 bp, Homo sapiens
gaggtaggcactattattagccctgctttacagataactgaggcagagacattgactcttccaaagccacacagctagtcagtgatggagctggacttcartctcaggcagtgtggccccccaattcatgctacagagtgggaggggtgtgtcagcaggtgcagcgtgggatcatgtgaactactctctccagctgctgtc

SEQ ID NO: 3564 - DNA, 201 bp, Homo sapiens
ggcagaagtgtctgtcctattataagtttattttatgaaacatgagctataatgtagtcctttttttttttttttctttttttggagacggagtctcggtygcgcctggctaattttttgtattttttagtagagatggggtttcaccgtgttagccaggatggcctcgatctcctgacctcatgatccgcctgccttggc

SEQ ID NO: 3565 - DNA, 201 bp, Homo sapiens
cccagggatgttcctagagctgatgttctgaggaataaggatgattatgtggggtgctctgtgtttctgaaaaattatataaatgaggcaggaaagacackcagtagtttgctctttgggtacacttgtagttagttggtaagctgcccaagggctttggcgattttattcactgatgtctctgaagtgccacaaaccact

SEQ ID NO: 3566 - DNA, 201 bp, Homo sapiens
gaagaggcaggaaaggtagactcaatctgccagacttagagctaaaaaaatttgcctggtatgtttccatgaagaaaattttcctgtagaagcagtggcaygacctctgttacaagtctgcttattgataatgaagctttttctgtgttatcaatttcgttgaatttatatgtatgtatatacatatacacacacacaaat

SEQ ID NO: 3567 - DNA, 201 bp, Homo sapiens
agagtattaaaggaagtgttccgagttctaggttgtgtttctttgatgcctactaaagctgagcacacctgagaccctgggtggagctctacaatgggaayaggagtaagtaatgtaggcttcgagagacaatcattctgctctcagtccttggaagactgttcctaggtatatatggcaaagcagatgaaattatttgag

SEQ ID NO: 3568 - DNA, 201 bp, Homo sapiens
atcccatgatagaaactgccttgcgcttctcactcacgctctcagcccggggaatcccagcggggaggagggagggaggtcgttttcttcagctccccagrtggtctgtgctgggtgtgctgacggtccttttgggaaaacaggtccacctttgccagcgtaattcagaaagagatgtaattttctgagagcacacacctg

SEQ ID NO: 3569 - DNA, 201 bp, Homo sapiens
cctcccaatgtgctgggattacaggcatgagacactgagcccagctgggatttcttttggtgtgaaggccagtgatcagtcactagtaggttttggaaggyacaataggtgtatagtggagaggcaaggttcttcagtggaaaggatataagctttctagtcacaccagcctgagttagaatctgtcctctgccacttttt

SEQ ID NO: 3570 - DNA, 201 bp, Homo sapiens
cacaataggtgtatagtggagaggcaaggttcttcagtggaaaggatataagctttctagtcacaccagcctgagttagaatctgtcctctgccacttttwacttgtatgacctcaatcaacttactttacttctgacttcagtgtcctttctgtaaaatgagtctattaataatgatattgataatagctaaaattgagc

SEQ ID NO: 3571 - DNA, 201 bp, Homo sapiens
taagctttctagtcacaccagcctgagttagaatctgtcctctgccactttttacttgtatgacctcaatcaacttactttacttctgacttcagtgtccwttctgtaaaatgagtctattaataatgatattgataatagctaaaattgagcatgtactatgtgccaggcattaccttgatttctctacatgcactgtct

SEQ ID NO: 3572 - DNA, 201 bp, Homo sapiens
atggttgtacagtttaaggacagtgtgagactcttaccagtcctggcagtggtgggaatccaaattcccaggcatcagctgagagccaccttgtaagtggrtctttcaaaggataacagtcaggcttgctatgttaccttttggatggggatgagagtggcaggtgaggatggtggtggggacccctgaacttggagaagg

SEQ ID NO: 3573 - DNA, 201 bp, Homo sapiens
tgggggattgttacactggtgtcctctgcctaccagctacccaaatttcagactcacacaaggaaagcagctgttcagcataaaccacatggttgtacagyttaaggacagtgtgagactcttaccagtcctggcagtggtgggaatccaaattcccaggcatcagctgagagccaccttgtaagtgggtctttcaaagga

SEQ ID NO: 3574 - DNA, 201 bp, Homo sapiens
tgtcctggaatccccaagaccacccccagtttcaatgattcactaggaggactcacagtactcagcacagagttgtactcatggctatgatttattatggytcaaagatgcaaagcaaaataagccaaggggagaagtactggagcgaagtccaaggcaagcaggcacaagcttccaaggctcctctcccagtagagttac

SEQ ID NO: 3575 - DNA, 201 bp, Homo sapiens
cctgctcagcttaatagctttaggcatgcagtcatcttagcataacttgatataagccgattctgagagtgggtgctgacatatggaagtgtttttgacartccacgttgtgaaggtcaggaggtttgctacaggaaagaaatccaagaagggcagtggcccactggtgttgggtcctctgagagtgagctgtgttctact

SEQ ID NO: 3576 - DNA, 201 bp, Homo sapiens
ggatttgaatccacactttctgactacagactctacgatgtgatcttttttttaaaaacagctttattgagatataattcatataccatacaataaaagtrtgcaaccagtggcttttagtactgtatattcacagagttgtgtggccatcaccacaattcattttagaacattttcttcaccccaaaaggaaactgcata

SEQ ID NO: 3577 - DNA, 201 bp, Homo sapiens
cctgggctcatgtgatcctctcaccttggtctcccaaagtgctgtgattacaggtgtggccaccatgcccggtgggtttggattccatctgcttgaggacraccatgggcaaactgctttctctgaagcatagtttcttcacgtataaagcaggggcaagaatactgactatatagtcactacattgaatgacttagtata

SEQ ID NO: 3578 - DNA, 201 bp, Homo sapiens
gctgtcagatcccaacgcccttctcagacccactgaattggaatctctagcaagggacctaggacactggttttaacaagtgcctctggtgattcctatcrtcagagaaatttaggacactgtcttatagaaccataaattttatgagccacgttttcaatttttattgaacatctcccggaggtgccttttccaggccag

SEQ ID NO: 3579 - DNA, 201 bp, Homo sapiens
tccctatccaggatccaaagttcactcattgcatttaatcattatctctttagttccttttaatctagaagggttcctctttccccttgcccctctacccsaccccccactttaaaaatggcattgggccaggttcagtggttcacgccagcactttgggagatggaggcaggcagatcacctgaggtcaggagttcgaga

SEQ ID NO: 3580 - DNA, 201 bp, Homo sapiens
ctgcacatgtactcctgaatctaaaataaaaataaaattaaaaaggattggctagcactgggaagagcagtcttttcccgcccagctagaaagttgtggtkttttttttttgttttttagagacttctccatttgcccaatttaaagtgcaaaagctgccttggcttgttgaagccttgacctcacaggctcaggtgattc

SEQ ID NO: 3581 - DNA, 201 bp, Homo sapiens
attactggtaccatccttcaactcgccctccttccagttgaaattattatcccctcttcactttgcaaaattctaactgcattgaaaaatttgctgttaartatactcgtacctcttgggtattagatccttcaccaggagtcagtattcattttggtgttcacccactcatctccctattttttatttatttatttattt

SEQ ID NO: 3582 - DNA, 201 bp, Homo sapiens
ttgagacttttatgaagcatgtcccttacgtggacagcttgcgattaatctttggttttagctttgacctccatcactgggcagcagcagtctgtggatayagaatctaaaagccgcctgttcagggggactttgggcagtgaacacttcggtatctgttttggggttggcttttaacatgtttctacattctttatgtaa

SEQ ID NO: 3583 - DNA, 201 bp, Homo sapiens
aataggcctaccctatcagtcatggttcagtcaagaagacatgtcattctagctatttcaaggagaaggggattcaatacagagtattagttgccttcagracaaagaaaaggcgagatgcgcaaaaaatggaagcccaccgctggctttctgatttgccgcaaaaaaagttagaaagctgctgccacccagagaagactc

SEQ ID NO: 3584 - DNA, 201 bp, Homo sapiens
gatcgtgccattgcactccagcctgggctggagcaaaactccatctcaaaaaaaaaaaacaaaaaaactttttaacaaatatgtacaacttcattaaaatmttggaaaatttattgtgcttccacatattggaaaatgctgttttagacacatgcagaattccagagaggtatggctatagagcacatctagaaagtcaga

SEQ ID NO: 3585 - DNA, 201 bp, Homo sapiens
tcctccctgtgaggaaacgagtttggcacatatcccctggcagcatctgacatggcataagtactcagggagtatatgtcgaatgaatgagcctcttggtsggctcttgtacttgcactgaattgtaattgcttgtttacacatcccacctccccactgggctgtgtgacttcctttgcatcataacttggggtgatttgt

SEQ ID NO: 3586 - DNA, 201 bp, Homo sapiens
tgagaatttcttgttttgggataaaactttttgctttcttacactgcagaaatctatattcttattatgtctaggcttctaacttagaagaaaaagtgttyttcacatgttcttttttcctcttacagtttgaacatgtgtgagtgtttactttgatggcttgagacttttatgaagcatgtcccttacgtggacagcttg

SEQ ID NO: 3587 - DNA, 201 bp, Homo sapiens
agatcagtatggaactcaaacaccctcagagctgccctggcctccttctttcctcctcaggtgcttaaacacattttaagtcatcgtgttccagttttaaytgatgaagcccaaagtatgtgagagggcagaataggaacaccaaacccagtctggggattcaacgaaagaaagctttttggaagaaatgaagccacaact

SEQ ID NO: 3588 - DNA, 201 bp, Homo sapiens
tgtctgttttggggacccatatagaaaaaagggtcctctgtcttgtggggataataaatgagttcttcattaagaacttgtttcttcttggtggagaatgkaactcctagactgatttaaaaataggaatgaaattgttggataatattctaatacccaagaagatgaataatgggtgtgtctagagcccatttttacaat

SEQ ID NO: 3589 - DNA, 201 bp, Homo sapiens
gactttggagcctaatttggaatcagtaaattgcattgctgtgtgtaaagtactgccctcacccccttaagaggatgtggcagaaggcctgaagcagtgaytaagtcaggggaggattcctgcggcaggtgatatttgaaaggaaacctgaggctaaaaagttattggctatgtgcacttatgggggaagagaaactcgga

SEQ ID NO: 3590 - DNA, 201 bp, Homo sapiens
aaattttttgtagagatggggtctcactatgttgcacaggctgcccttgaactcctaggctcaagcgatcctctcgcttcagcctgagtgctggaaatacrgacgtgagccactgcacccagccctcttctaatttcttaaaacataaacacatagtccgggtggcttggtggctcatgcctgtaatcccagcactttggg

SEQ ID NO: 3591 - DNA, 201 bp, Homo sapiens
aacagtttactgcccggccgcactgagtactcgcaatgtcttgaacacccttgcaggttacccctcctggctctgaacgggctgttccctctatgcagaaygcccacccacctgaccagttagtcatccttcagcatggagctgtgggagagggagcctccctgtggttgggacatacctccctccaccccaggcctctca

SEQ ID NO: 3592 - DNA, 201 bp, Homo sapiens
accttttggatggggatgagagtggcaggtgaggatggtggtggggacccctgaacttggagaagggatctgttaatgcagcctcggggcctggtgctgcrggagaaggtggaaggaagtgaactggggttttgcacctagatcctgggttcagaatgataactgggattcctgcactacacggatagagaagggtggaaa

SEQ ID NO: 3593 - DNA, 201 bp, Homo sapiens
ctttcctgtaagaaagggaattcttttagtctttctggccgtagtcccagggatcatgactaagttctctccctctttctgcctgtcactgataattaacstaaaaccaggatgagttttgcaaaccagaagcaagatttctttgtgcgaggagtgactgtcatctctaaaactggagtttgtgtccttgtgtgtatttgc

SEQ ID NO: 3594 - DNA, 201 bp, Homo sapiens
tttacctatatgtgtatgtgaacatggacttcagaattaattagtgtggtaattattatttctattgtagactttaatcagccatattaaatatatgcatyatgttcacagagaaaacatggtatcatctttggaaactttacagtatgctctatattatagataccctatataactatggtactaaacacacgagttagt

SEQ ID NO: 3595 - DNA, 201 bp, Homo sapiens
gaggcagagtctcactctgtcgcccaggttggagtgcagtggcacaatctgggttcactgcaacctccgcctccccagttcaagtgattatcctgcttcascctccccagcagctgggattacaagtgccaccacacctggctaattttttgtgtttttagtagagatggggttttaccaggctggtcttgaactcctgaa

SEQ ID NO: 3596 - DNA, 201 bp, Homo sapiens
tattacaaagtagcccttaataagggaagttgaatgtgccttttttttgagagagagaacgtttccttaagctggatgaaatagcattggatcagaggacraacaagatcttccttgtacctataatactctttgagttctgtgaatacacagggataaaacatttcactgatcacttttttttttttttttgagacagta

SEQ ID NO: 3597 - DNA, 201 bp, Homo sapiens
aaagtgctgggattacaggcatgagccaccgcgccctgcggagtagaagttctttggataaacacattctaggagtggggtcaaaatgtgcaaacccacaygtgaagaagatgactaataaattgtttctccaaagagttgtattgatttacactgccaccagcaaaaaagctaatatatcaactgaaccgtgtttctaac

SEQ ID NO: 3598 - DNA, 201 bp, Homo sapiens
cagccatattaaatatatgcattatgttcacagagaaaacatggtatcatctttggaaactttacagtatgctctatattatagataccctatataactayggtactaaacacacgagttagtgacaagtcaggcatttggagggaatgtttgtaacccattgtgggagagagttattagaatagttattcttactggtag

SEQ ID NO: 3599 - DNA, 201 bp, Homo sapiens
aaaattagattggtggttgcctagggccaagaggcagagagagaattgggggctcagggaatgatggctaatggttatggggcttttcttgtggggttaakgaagatcttctaaaatggattgtgggccgggcgcagtggctgacgcctgtaatcccagcactttgggaagtcgaggtgggtggatcacctgaggtcggga

SEQ ID NO: 3600 - DNA, 201 bp, Homo sapiens
acaggataacttctcaggacgaagtctaaagttaactgtatggctgcattggataaatagctcaaaagtttaggttttgttggtgtttaaagcctctgtgractaagcacagtggctcacgcctataatcctgcactttgggaggctgaggtggcaggaacgcttgaggccaggtgttcaagatcagcctgggcaacctag

SEQ ID NO: 3601 - DNA, 201 bp, Homo sapiens
tatagagtaaaaaattagattggtggttgcctagggccaagaggcagagagagaattgggggctcagggaatgatggctaatggttatggggcttttcttrtggggttaatgaagatcttctaaaatggattgtgggccgggcgcagtggctgacgcctgtaatcccagcactttgggaagtcgaggtgggtggatcacct

SEQ ID NO: 3602 - DNA, 201 bp, Homo sapiens
tggtgcgatcttggctcactgcaaactccgcctcccaggttcaagcgattctcctgcctcagcttcccgagtagctgggattacaggcgcccatcattacrcccggctaatttttatatttttagtagagacggggtgtcaccacattggccaggctggtcttgaactcttggcctcaagtgttccgcctgccttggcctc

SEQ ID NO: 3603 - DNA, 201 bp, Homo sapiens
gcagtgagccgagattgtgccactgcactccagcctgggcgacaagtgagactgtctcaaaaaacaaaaccataaacacaagccagtgttataaatgctaygaaaaacaaattcccttttggtttaaaatgttttctctgtagtatactttggaatggtaaattttatgttatgtgtattttactataataaaaaattttt

SEQ ID NO: 3604 - DNA, 201 bp, Homo sapiens
ctagaaatatattgacagaatttggttttatctctttttctccagacttttagtcggccagggctaacaatggatgtccaaacagtttacagtggctgatrcacaatgcacaaagggcttcactgtttggagactggaaaatagagccagaggggagcttcttatgggcattgacctaattcactccttttggcaaaaatg

SEQ ID NO: 3605 - DNA, 201 bp, Homo sapiens
tcaggcccccccttttccatggtgttcacaaaggcgtaggcattagggagcttgtgcatatataccaaagctgactgttcaaacagccagaaataaaatcygactcgactccctttctgcaccctcttcttaccaactcactgcagaagacttattgggctgtgttgactggacccaggccagtggtgtggaaatagctat

SEQ ID NO: 3606 - DNA, 201 bp, Homo sapiens
aggggaggattcctgcggcaggtgatatttgaaaggaaacctgaggctaaaaagttattggctatgtgcacttatgggggaagagaaactcggagcagagsctgtacattaaaagagtctggagatgctgcactaggtgagaagaaaaggtttgtgtttgttctgagaattccattgtgactcctatatgtaaaccagaaa

SEQ ID NO: 3607 - DNA, 201 bp, Homo sapiens
actcctgccagtcactgtgggggatacaaagatgaacaagattcaatttctgcatttaggggtctagtggacctgaaactgttagactttactctgcaatmtgtgtcgggattcctgagactgagggagggaatgtatgatgccgatgcacactctgcaatacagaaatttagcaaagagtgggattggtcctatatgcat

SEQ ID NO: 3608 - DNA, 201 bp, Homo sapiens
tcacttatattaaaaactgaaatccaaatgtgtgtttgtacaaacatatgtaaataacataaaaagaattgtaagaccagacccttttcttctgaaaaacrtacacagcattttgcaaataattattttttaaaaagtatctttattttattttatttttttttttttgagacggagtctcgctctgtcgcccaggctgga

SEQ ID NO: 3609 - DNA, 201 bp, Homo sapiens; identical to SEQ ID NO: 1645

SEQ ID NO: 3610 - DNA, 201 bp, Homo sapiens; identical to SEQ ID NO: 679

SEQ ID NO: 3611 - DNA, 201 bp, Homo sapiens; identical to SEQ ID NO: 3446

SEQ ID NO: 3612 - DNA, 201 bp, Homo sapiens; identical to SEQ ID NO: 3447

SEQ ID NO: 3613 - DNA, 201 bp, Homo sapiens; identical to SEQ ID NO: 2218

SEQ ID NO: 3614 - DNA, 201 bp, Homo sapiens; identical to SEQ ID NO: 2219

SEQ ID NO: 3615 - DNA, 201 bp, Homo sapiens; identical to SEQ ID NO: 2220

SEQ ID NO: 3616 - DNA, 201 bp, Homo sapiens; identical to SEQ ID NO: 2221

SEQ ID NO: 3617 - DNA, 201 bp, Homo sapiens; identical to SEQ ID NO: 2222

SEQ ID NO: 3618 - DNA, 201 bp, Homo sapiens; identical to SEQ ID NO: 2223

SEQ ID NO: 3619 - DNA, 201 bp, Homo sapiens; identical to SEQ ID NO: 976

SEQ ID NO: 3620 - DNA, 201 bp, Homo sapiens; identical to SEQ ID NO: 2677

SEQ ID NO: 3621 - DNA, 201 bp, Homo sapiens; identical to SEQ ID NO: 1501

SEQ ID NO: 3622 - DNA, 201 bp, Homo sapiens; identical to SEQ ID NO: 1502

SEQ ID NO: 3623 - DNA, 201 bp, Homo sapiens
tttagggacctgaggagccccgggatcagccaagccagacttctcttgtgatcgggaaggcaactgaggcccaaggtcacggtgtcagcaaggtgtcagcraggttccttgggtatgggacccaaagcctccggatcccagcctggagcaattagagtagtagtagtggtggagatttatggagttctgttctggtgttca

SEQ ID NO: 3624 - DNA, 201 bp, Homo sapiens; identical to SEQ ID NO: 1503

SEQ ID NO: 3625 - DNA, 201 bp, Homo sapiens
catcaaatgtcaagtaccaagaaataaacggtttgctatatacaactaagagatataagacagttcagaatttggaaagcttaaaagttaaattactatamtaaactaagtgttttaaaataaataagttgggggaaaatatttgaatcaactacataaaggcctatgtatcttagtttgaaagaaagtgataatatctct

SEQ ID NO: 3626 - DNA, 201 bp, Homo sapiens
atactgattttcttgtcaacagaaagtcacaaactaacttcattacaagaatacttttgtaaaaagggggattttcacagattccgactaaagaatgccayggaccttttaaagaacctagtctaatagtgaataatacacaataaataaaagatatcatatttaagaatgtattaactaatgggggggacaacagtttta

SEQ ID NO: 3627 - DNA, 201 bp, Homo sapiens
atcctgcggatggactaccctgggttcttccagtaaatcctcttttgctttacttggccagagatggtttttgttgcttgtaaccaagaatcctaatctayagaaaaattgatgctcttatggaaaaaagaaaaaaaaagatcctaatctataaattaacttcttacttatgtgccaccactgggctaagagctttacatt

SEQ ID NO: 3628 - DNA, 201 bp, Homo sapiens; identical to SEQ ID NO: 1575

SEQ ID NO: 3629 - DNA, 201 bp, Homo sapiens; identical to SEQ ID NO: 1576

SEQ ID NO: 3630 - DNA, 201 bp, Homo sapiens; identical to SEQ ID NO: 1578

SEQ ID NO: 3631 - DNA, 201 bp, Homo sapiens; identical to SEQ ID NO: 1583

SEQ ID NO: 3632 - DNA, 201 bp, Homo sapiens; identical to SEQ ID NO: 1584

SEQ ID NO: 3633 - DNA, 201 bp, Homo sapiens; identical to SEQ ID NO: 1598

SEQ ID NO: 3634 - DNA, 201 bp, Homo sapiens
tctcgttctcacatgcaacataccagagacatgcaaatgtgccgtgtgtacactgtccagtgatggcttcaacactctccacatcagtctcctcatctccrtgtttccctggccaccgctctgcctttcactctgtgctgtgctcatgtctctccccagatggaaatgttcaatgattttgtgctgtgtaggatcaacttc

SEQ ID NO: 3635 - DNA, 201 bp, Homo sapiens
gccttttgaaataaacgctccatcttaaaaatgccaggacccttcttaatagctatcatagaagttatacctccgatcaaatcaaccatttacaaaaagawtgatgacaggtgccttcacttcaagctctgttttcatatttccatacccatgtttaaaatccccttaatagttgcactgaactgacgtcatctttctgat

SEQ ID NO: 3636 - DNA, 201 bp, Homo sapiens
aacattagcaacaaagtcatccaagaagtcatctctgagaacctcaagtccacgctgaaacaggaagtgaattttctcctggtgggccttttgaaataaaygctccatcttaaaaatgccaggacccttcttaatagctatcatagaagttatacctccgatcaaatcaaccatttacaaaaagaatgatgacaggtgcct

SEQ ID NO: 3637 - DNA, 201 bp, Homo sapiens
cttacctaagcacaatataaggtcacttttcagataacaaaaagaaactatcacatcatctgtgcattattcagttaatctagcagatttgtatcagaacygaaatagcatatactatggggaaaaaagattgcaaagaggacctaaaatccttttttccttttgcaagaaacttcttttcatttttgatacaagatttca

SEQ ID NO: 3638 - DNA, 201 bp, Homo sapiens
gttgtggatgacaaataacctccacataaaatgttctatacactgaggcatctttgatccatcttactggctcagtgactcacaaaggaggaaggaggggrgatgtctgaaaacaaaagggcagcctgacgacaccatttagttatttattctgtatgttcagctcagtttttcctctttccaacttttcatgatactata

SEQ ID NO: 3639 - DNA, 201 bp, Homo sapiens
ggataatgcctacatttctggcatcttctacagagactatggctcttcaaaattccaaagacttacatcccctctgacagaagttattctcaggtgccaawttcataactagcttgatctagtggcacttctgaaggacagttttcttttctgtgtattttggctgctatctgaattctctttgaaataaatttcggtttg

SEQ ID NO: 3640 - DNA, 201 bp, Homo sapiens
cttagagagcatgaagatgtatggggcagtgtacagaggggaccaaaaggggagattcagaagaattagataaaagggcagcaggaaaccaagaaagaggygccaccaaagcccatagagcaattacacattaagtaggggaaggggccagctctactaagcaaaggggtggcaacagtggagactgtttgtgttccgtta

SEQ ID NO: 3641 - DNA, 201 bp, Homo sapiens
gagactgtttgtgttccgttaagtgaaaattaaaacatagagcaacaagaaagcattaaaaaagtaacttccctcaactcaaatgagtccagcatgaccaycagacactgggcattgtgtggctaggtaagatgagttgggaggcacggaaactgccaaaaaggaactcaggactggcctgggggcacctctgtaatatct

SEQ ID NO: 3642 - DNA, 201 bp, Homo sapiens
gcagttatggctgtgtcatctggtacctgcactgcctttagaaggcagcacagattagccattcatggaatcggtacttatctggtgcctatttccagaakagtttgtgtggggagacaattctcacatctacacttttttggggggcagggtgggggggatagagtctcgctctgtcgcccaggctggagtgcagtggcg

SEQ ID NO: 3643 - DNA, 201 bp, Homo sapiens
cactgatgaaatctttcttttctaagaaacacaggacatttatacatttaaagagaggaaaagtgactgttattaaacagatgtctgtgctacagtcaatrtatcattctttcattttaaagtgttctaatttaactgtaaatattaaaagttcctaagaaataactccatgtttcaggtacattttagtaaacatcttgc

SEQ ID NO: 3644 - DNA, 201 bp, Homo sapiens; identical to SEQ ID NO: 2710

SEQ ID NO: 3645 - DNA, 201 bp, Homo sapiens; identical to SEQ ID NO: 2711

SEQ ID NO: 3646 - DNA, 201 bp, Homo sapiens; identical to SEQ ID NO: 2712

SEQ ID NO: 3647 - DNA, 201 bp, Homo sapiens; identical to SEQ ID NO: 3446

SEQ ID NO: 3648 - DNA, 201 bp, Homo sapiens; identical to SEQ ID NO: 3447

SEQ ID NO: 3649 - DNA, 201 bp, Homo sapiens; identical to SEQ ID NO: 2713

SEQ ID NO: 3650 - DNA, 201 bp, Homo sapiens; identical to SEQ ID NO: 2714

SEQ ID NO: 3651 - DNA, 201 bp, Homo sapiens; identical to SEQ ID NO: 2715

SEQ ID NO: 3652 - DNA, 201 bp, Homo sapiens; identical to SEQ ID NO: 2716

SEQ ID NO: 3653 - DNA, 201 bp, Homo sapiens
ctgcctccaccacccatccctgctctgcagaacccctgggtgctgagtggcaggagccccagggttgtcccatctgggtatggctggctgggtcactaacytctgtgatctgcttccttcctttccagattatgcggatcaaacctcaccaaggccagcacataggagagatgagcttcctacagcacaacaaatgtgaat

SEQ ID NO: 3654 - DNA, 201 bp, Homo sapiens
aaacaggccttcaccagtgttgatggtggaaagcttagggaagtgcttcaaacacagtaggagggacttacgttagattttggaaggacttgcctgattcrgaagctccaaagagtggcattacagagctgggtggagagaggggctagccatcttttgtgtcgcccaccgggctcatgtgtcatcgcctctcatgcagtg

SEQ ID NO: 3655 - DNA, 201 bp, Homo sapiens
catttagtgtcatttcctatatagacatgtcccatttgtgggaactgtgacccttcctgtgtgagctggaggcacagagggctcagcctaatgggatctcycctcccttccctggtttgcattcctttgggggtggagaaaaccccatttgactatgttcgggtgctgtgaacttccctcccaggccagcagagggctggc

SEQ ID NO: 3656 - DNA, 201 bp, Homo sapiens
aggtgttgggggaagtgtcccttgtttcccctagctcccaggggagagtggacatttagtgtcatttcctatatagacatgtcccatttgtgggaactgtracccttcctgtgtgagctggaggcacagagggctcagcctaatgggatctctcctcccttccctggtttgcattcctttgggggtggagaaaaccccatt

SEQ ID NO: 3657 - DNA, 201 bp, Homo sapiens; identical to SEQ ID NO: 3451

SEQ ID NO: 3658 - DNA, 201 bp, Homo sapiens; identical to SEQ ID NO: 3452

SEQ ID NO: 3659 - DNA, 201 bp, Homo sapiens
ttttcagtgtttagtttaacaacacatctaaaattttgaattggcaggtactttttaaataatgtcatcaagtaaaccagagctgcgttattgtatttatyatgcacacaatgagatgataggaatctattttaatcatgctcttaaaggcaaagtcttgaacaaagtaaaagatatttctctttgcttcatgtagtaatt

SEQ ID NO: 3660 - DNA, 201 bp, Homo sapiens; identical to SEQ ID NO: 1889

SEQ ID NO: 3661 - DNA, 201 bp, Homo sapiens; identical to SEQ ID NO: 1905

SEQ ID NO: 3662 - DNA, 201 bp, Homo sapiens; identical to SEQ ID NO: 1424

SEQ ID NO: 3663 - DNA, 201 bp, Homo sapiens; identical to SEQ ID NO: 1428

SEQ ID NO: 3664 - DNA, 201 bp, Homo sapiens; identical to SEQ ID NO: 1429

SEQ ID NO: 3665 - DNA, 201 bp, Homo sapiens; identical to SEQ ID NO: 1430

SEQ ID NO: 3666 - DNA, 201 bp, Homo sapiens; identical to SEQ ID NO: 2642

SEQ ID NO: 3667 - DNA, 201 bp, Homo sapiens; identical to SEQ ID NO: 2643

SEQ ID NO: 3668 - DNA, 201 bp, Homo sapiens; identical to SEQ ID NO: 2644

SEQ ID NO: 3669 - DNA, 201 bp, Homo sapiens; identical to SEQ ID NO: 2646

SEQ ID NO: 3670 - DNA, 201 bp, Homo sapiens
ctggagggtccaggagccccctgaactgagtatccggtgggaggtcagatttccgcattcagaacgagagctcatacggcatccacgcgtgtctttctcaygcatatccccagcccgagtagaagaggacttctgcatctctgttagttctttctcctcctaagaaaaagcagattttaagtaacttatcatttgttcatt

SEQ ID NO: 3671 - DNA, 201 bp, Homo sapiens
cttaatctcccttttccatgggcccaacacctgaatctagggcaaacaggtgtcccccagattggatcctctgctctaggacacattcttgtcctagagcrggttgggcaagaggcttttctctcagtcaccagccccaaaccctgtggtcttgccagcccaggacgtgtcaagactgcagcctttgctgacctgtgacca

SEQ ID NO: 3672 - DNA, 201 bp, Homo sapiens
tataattttgatgaaagaggtttcctaacagtatttcggtgtgcatgctcacacaccagccctggtcatcagtgaacagattcttccaggtcttcattgtrgcggaagaaagtgagatcagagatcccgaggaagggcttcagtttcaccagtagtggagctagggagtagcggggcagaagccgcaggaagtcagtgcag

SEQ ID NO: 3673 - DNA, 201 bp, Homo sapiens
tgcttctgacacccagtaagcagctctggcttttataattttgatgaaagaggtttcctaacagtatttcggtgtgcatgctcacacaccagccctggtcrtcagtgaacagattcttccaggtcttcattgtagcggaagaaagtgagatcagagatcccgaggaagggcttcagtttcaccagtagtggagctagggag

SEQ ID NO: 3674 - DNA, 201 bp, Homo sapiens
tggatttggcagctggttttgtctggatttgaaagggaggtaatcaggggtgtgctgggagggccagaacgatccacccacgtgttggtgccacccggcartggaaaagcctctggcctcggccttctccggaaggttgtccgcggtgccagtgagagctgcttttcaccttacagcagccccggcctatctctcaggagg

SEQ ID NO: 3675 - DNA, 201 bp, Homo sapiens
tcattatatgcctccaaagactttgtgtttcctatgtttgacatcgagatagaatttttcataaccctttactagtaataaatttgattgttaagggaccrggttaatcttatttctaataccagcatctgattttaaaaccctgatttaggagcattttctttctgctaccttcctaaaacgcatgggtggaaatgtata

SEQ ID NO: 3676 - DNA, 201 bp, Homo sapiens
tgccatccacggacggcttaagtgttaacagttcagtggagggtcagcgtgacagccttttgcacccacatctgggttcttgtccagtgtccaggaggaaygaggtctcatgagcaaattttaaggatggcagatgtgggggattttattgctgatgaaagtggctttcactgggaagataagctaaaaagaagacaaagc

SEQ ID NO: 3677 - DNA, 201 bp, Homo sapiens
acatcttcccctttcttctcccccaggtttgtcccatttgtactgactctgacccaggttgtcatgacttgagactcactagaagtttcagaaagatgcasactgctttaaaaaaaaaaaaaaaaagggcaaggggaggtgtgagaagaaagtataattctttttcttctaacgggagatataaaaatcatataagcatga

SEQ ID NO: 3678 - DNA, 201 bp, Homo sapiens
tgccattgcactccagcctgggcaaaaagagcggggtaaaaaaacaacaaaaaaatgatgtaggaatgaacagatgaacaaccccacacaacctaaggacractttgaatcaattcttctaagctggtagcagaagccacctttccatttgacttgtatctcgctctttttttctttcttttttttttttttggagacaga

SEQ ID NO: 3679 - DNA, 201 bp, Homo sapiens
aaactgtgtgattctgtctgcagttgagaactgtaagaaaaagatcaagattaacattattattattggtgttacctcatgtctgtacctttttggagacktgggtctgtttcccgagaaatcatttttcctcctccttgaaaatagtgaatttcaagtggttttaattttaactgcattatttgtttgctttatatagtt

SEQ ID NO: 3680 - DNA, 201 bp, Homo sapiens
tgaggattaattgaaataactcgcaaaaatatccagctctctgtttccctgctaggggctcttgtcataggagccattgttgtagccttagaaaacatacrgcattattttagggggagaggttagagtagaattttaaagagtgcatttctcttccagtaagcaattctgcatcgataaaaagtggagaaagaataagtg

SEQ ID NO: 3681 - DNA, 201 bp, Homo sapiens
tggcccaccagctatggtttggacaagcttagtctacaggttcttcaagaggggcttgagcatttgaaagacttctagtgggagagatcacaaggtacaastagaaaatcctgggctggcctgagaggcagacctgtgattattttgctctttgaaagttgtccttctgcacccattttccccagacctaacctcgatttg

SEQ ID NO: 3682 - DNA, 201 bp, Homo sapiens
aaaaaaaatccccaaaaaatctcataatgttttaagaaagtttatgaatttgtgttgggccagattcaaagttgtcctgggccgcatgtggcccaccagcyatggtttggacaagcttagtctacaggttcttcaagaggggcttgagcatttgaaagacttctagtgggagagatcacaaggtacaactagaaaatcctg

SEQ ID NO: 3683 - DNA, 201 bp, Homo sapiens
gcaatctatggtctttatcacttctccattaactgtccttgttttattaatgctgattactttttgatttggtttggttctttggagttgtttgcatttcrtgagtcttggcatctttttggtagagaaccttgctaggttctcacaatgtagaaattaagcagaaaacagaggtctcaatttgccttttcagcgtgaatg

SEQ ID NO: 3684 - DNA, 201 bp, Homo sapiens
ggtcttctgaagtataggaaaaggcagcttacagaaaaaaacttgcttgtttactgtcttctgagctgatttctcacctactggcaagtggataggtctastttttgtttagctgtttttctaatttaatcttatacatgagacagctatagatggatgtatagtctttgaagtggggccagttggctccgtctattagct

SEQ ID NO: 3685 - DNA, 201 bp, Homo sapiens
atgctaaccaggatggtctcgatctcctgacctcgtgatccaccagccttggcctcccaaagtgctgggattacaggcattagccaccacacccggcccarattttcttataaagtcaaatgggagatacttgtttgcaggaaatagttcttttggttcttacttttccataaggattgagtctcaaaatgtctggtagca

SEQ ID NO: 3686 - DNA, 201 bp, Homo sapiens
ttgaccttgctataaggtggtggtgagccccatgaccacaggtgacgtcgtaggatggggaatttgaaagagcactcttctgacttaaaataccacacagktcctttattggaataatttcagccttaatgagactggggttgtctttttaaaccctgtcattacaggcatcactgtggcgcattaacaccaggactaact

SEQ ID NO: 3687 - DNA, 201 bp, Homo sapiens
ggtaaatgaagatctgttacgtgtactatgtcaaaaataaagtcacctaaaagaaaacttaagcatgacaccaatacttgggaaaaaatggtttcaaatayactggttaactggtgtttttattaaaatattcctttatgcaacgtttgtatatatttttaaagaaattatgtcaagccagattttacatcaaattctttt

SEQ ID NO: 3688 - DNA, 201 bp, Homo sapiens
gttaacgttttgaagctattgagggccaagattttttcacaaataatgagaaagacttagaaaaaaacaacaaaaaagaaaacaaccctaagaaaaatcartcatatcaaagcaccttccttttgtgcaagcagtgggcatgggggtggctggtttagtcacctcagtatctgctgggctctccatcactcaatgatggtg

SEQ ID NO: 3689 - DNA, 201 bp, Homo sapiens; identical to SEQ ID NO: 1666

SEQ ID NO: 3690 - DNA, 201 bp, Homo sapiens; identical to SEQ ID NO: 1667

SEQ ID NO: 3691 - DNA, 201 bp, Homo sapiens
agccatctgtcaatcagaaacactcattttgactttacgtgagaaataaccttctgttgtgttaaaccaccgacattttgggacttggctataatcacaayctggactattctaatatacttactaaagtacagcatttcttcacattaccatcaaaattatatgtggttagaaaacacaattacgttacagtgctttcca

SEQ ID NO: 3692 - DNA, 201 bp, Homo sapiens; identical to SEQ ID NO: 1714

SEQ ID NO: 3693 - DNA, 201 bp, Homo sapiens; identical to SEQ ID NO: 1645

SEQ ID NO: 3694 - DNA, 201 bp, Homo sapiens
ctccaatttttaaaatcgaatgcattttattttcttattatccatcattgactcagtagcattcaagaggttgggtttgtaataattctactcagttgctwtattttacgttgtttggatccctcctccaaaaaatatacacatatgttttactgtctcctcatagtaactcagctttgtaatcacactactaccaagtag

SEQ ID NO: 3695 - DNA, 201 bp, Homo sapiens
gctaaatactactcagtcaaatgctttcagaatccaagtgtgtttatttgcacaataaacatggtactttacattctgaaagctctaacattcgcaaagcmctcatgagctcatacgaaggagacaggtgagtatccatgcttccatctcgcaaatgtcatgttacaaagcaggaaagcaggacaggtgagatgataaact

SEQ ID NO: 3696 - DNA, 201 bp, Homo sapiens; identical to SEQ ID NO: 3071

SEQ ID NO: 3697 - DNA, 201 bp, Homo sapiens; identical to SEQ ID NO: 2794

SEQ ID NO: 3698 - DNA, 201 bp, Homo sapiens; identical to SEQ ID NO: 1477

SEQ ID NO: 3699 - DNA, 201 bp, Homo sapiens; identical to SEQ ID NO: 1478

SEQ ID NO: 3700 - DNA, 201 bp, Homo sapiens; identical to SEQ ID NO: 1479

SEQ ID NO: 3701 - DNA, 201 bp, Homo sapiens; identical to SEQ ID NO: 1480

SEQ ID NO: 3702 - DNA, 201 bp, Homo sapiens; identical to SEQ ID NO: 1481

SEQ ID NO: 3703 - DNA, 201 bp, Homo sapiens; identical to SEQ ID NO: 1482

SEQ ID NO: 3704 - DNA, 201 bp, Homo sapiens; identical to SEQ ID NO: 1483

SEQ ID NO: 3705 - DNA, 201 bp, Homo sapiens; identical to SEQ ID NO: 1484

SEQ ID NO: 3706 - DNA, 201 bp, Homo sapiens; identical to SEQ ID NO: 1485

SEQ ID NO: 3707 - DNA, 201 bp, Homo sapiens; identical to SEQ ID NO: 1486

SEQ ID NO: 3708 - DNA, 201 bp, Homo sapiens; identical to SEQ ID NO: 2547

SEQ ID NO: 3709 - DNA, 201 bp, Homo sapiens; identical to SEQ ID NO: 2548

SEQ ID NO: 3710 - DNA, 201 bp, Homo sapiens; identical to SEQ ID NO: 2549

SEQ ID NO: 3711 - DNA, 201 bp, Homo sapiens
gagaaggccactcacctccaacgacccttccttcctgccctgcctagcccacagacatggctggtcccagcctgggccacagatccctgtctaggaaatcractcttcctcccccagcatccccaccttccacagaacaggcagcaagaggacaaggcagaaatccaggaaggaactaaggctccttaaagtgggcacagg

SEQ ID NO: 3712 - DNA, 201 bp, Homo sapiens
cccaaattgtcaccagtcatccctagctccttgcagcccctgacacacacacacacacacacacacacacaaacacacattcatgtctctcttagggtacrgcttgctcctgttgaatgggcagacatggttccagcatcgacggatgctgaccccagccttccactatgacatcctgaagccctatgtggggctcatggc

SEQ ID NO: 3713 - DNA, 201 bp, Homo sapiens
aatcattatctgaaatgtttcattgtagaagcagcaatgtgggctccaagtagatgcagcagatccacatgtccctctgagggaaagccatggtgccaatrggcaagaacaccatgatgtgcaaggccatccaagggcacctggaaaacaacccagctctggaaaaactgttgcctcatatccagggaaatgtgggctttg

SEQ ID NO: 3714 - DNA, 201 bp, Homo sapiens
ctatggatactaagaccttgtgattgttaaacctgatgaaagcttttagtcctcactttatttggcctctctagtatgactcatccttggtttctaagatrccaaattttcttattatctgttccactatgactcagtttctgttgtgggttccttttgcttatgtgtcccttaaatcttatttttcctcagcaattgctc

SEQ ID NO: 3715 - DNA, 201 bp, Homo sapiens; identical to SEQ ID NO: 2855

SEQ ID NO: 3716 - DNA, 201 bp, Homo sapiens; identical to SEQ ID NO: 2856

SEQ ID NO: 3717 - DNA, 201 bp, Homo sapiens
ctagaggtggtcagctaatacttttctcgtcaatggcaagatgttccacaccaccaccaccattttccacccagacaccttttttctgacaggcatcccgrgacttgaggctttccatggctggatttccatgcccttttgctgtatttacttgatgcctctgctgggcaatgctacaattctactgacaatctggtctga

SEQ ID NO: 3718 - DNA, 201 bp, Homo sapiens
tgaaggattgaatgtggaagtggccttttctaaggggtagaagcaaaaaaaacctctcacttttccacctcagcccaccactatcatgaaaaatgcccaamgtgggacgaaaactcacgtgagttctctgcacttcctgccagcctctggcacacacactaacacacttgaatcccaaagttagccaagctgcacttccct

SEQ ID NO: 3719 - DNA, 201 bp, Homo sapiens
ggcccccatccggccagggcctggctgccagaggccaggagagaaggcagaggcctcaggccaggaggctccactgagtgtggagagggggaaaggggcargaacaatttcaaaccacatagcagctccctgagaaggataaggggcctctgaaccaggccagaaaccaacctgagccaggagcactgggccgagagcaca

SEQ ID NO: 3720 - DNA, 201 bp, Homo sapiens
aggcagcagttggaagggtcctctcttctgggccatccgcttcctcctccactaccatatagctctaccctctccactgtgtgttcatgggtgatgttagstgggcacagccaagggatggcatggaagaggggttatctcagggcctgtcctagagaagcttgggcctaggacaccctcaacaggaccatacatgtacca

SEQ ID NO: 3721 - DNA, 201 bp, Homo sapiens
ctgcccaagccattccattctcattacaccccaggttctagcccttatttccattcatcaggactatggcaggtgctgcctaatctgccctgcctcatacrgtaggcaatactgcctctcccgcaaaagtccatgccctaatcctggaacctatgaatacgttacatgacatagcaaagagggttttgcagatgtaattaa

SEQ ID NO: 3722 - DNA, 201 bp, Homo sapiens
gcagccagcctggattccatcctgactgcccactgcccaagatccgccctcaccctccacgcccccacacaacctctgcccccacccaccaatcggcacayatttcccaagcacctgcttcaggactggagtaaacccctccaggacttgaccttccaggaagatgtgggccaaagccctggggcctaagaaagagcacag

SEQ ID NO: 3723 - DNA, 201 bp, Homo sapiens
catggcaaaaggagctttttagatagtgaggcacataacaagtgccgcagcagcctctgctggccgccttagccttccacacctgacgcacggccgaaaasgccggcggaccctcggaactatgcttaccatgagtccccgctggcccgggacaattctggtctacagctgttgtctctgcataattactaatagcaagca

SEQ ID NO: 3724 - DNA, 201 bp, Homo sapiens
agcatgtacacatgtctgtatgcttattataataatgaccatatttattgggcacaaaaggtcaatacatgttagctattgttattattgtaattttacayggttaatgaaaataatgtagaagtagggggttgttaagatgagcttcctttatttcctagggttttgattcaataaactcttttcagttttagcagtagc

SEQ ID NO: 3725 - DNA, 201 bp, Homo sapiens
aacagtaggagccagctctgagctgtgccagaggagaaatggctggcaggggtgccaagcagggtgctctggcaggcaattaggccccagacaatggcccrcaaatgtcagaagtggcgggaaggctggaattcactgaggccttgggcatatggaggagcacatggaagggcacagggatgaccatgtgccgatggagcc

SEQ ID NO: 3726 - DNA, 201 bp, Homo sapiens
ccgccaggatgggtgtcctgctgcatcactccgcttcccacccagccaggctaatgcatgagaatgtcctttttgtcattcacatccctcttgcatttcascactgactcttctgctccggccagcacccctcagccctgcctaatttgaccacggctcacgctgggagatcatcaccacggaaagggtgggggcagtccc

SEQ ID NO: 3727 - DNA, 201 bp, Homo sapiens
aataatgctttattactgtaggttaaaaagcacacaaacatgcttgacacagtaggtgctacatcagtttactattgttgttgttttcagattggattttrtaaaaactctacttatttgcaatttataagaggcatacctaaaatataatgtcagagaaaggttaaaaagtggagccagggaaggaatttaagaagacat

SEQ ID NO: 3728 - DNA, 201 bp, Homo sapiens
cagtaggatattatgaatattatcaatggttgtaccctcattgtgacattaggtgtaacatctccgtaggatattacgaataatataactggaagtatacmctgtatgatattaggagtaacatcttctttggatattatgaataatattaattaacaattacgataataattattaatatgatattattcataatttcct

SEQ ID NO: 3729 - DNA, 201 bp, Homo sapiens
gcagaggtgggtattgctgaggcggggcacacaagagccttcagatagactggggatgtttacttcttaatctgctcctggggccatttattcttcttcaygcctttcaaaatatgtctcaagtaggtaatagtaatttaaaaacttgcaactcagccattgggagggttttgttggcctctttaaccaagtcctttaacc

SEQ ID NO: 3730 - DNA, 201 bp, Homo sapiens
aaaagaacaattatggtttgtgttattagactctacatatacctactctttttctcatagatggtgcgttagattggaaggccaccttcctgtgaaggaarggagaaccaactcttattgagtgctgtctattgtgctaattattatccacatctaaagataaaatgagttccagggagattaggcagttatcctggggtt

SEQ ID NO: 3731 - DNA, 201 bp, Homo sapiens
atctgcttattgacaactttatccccaacacctagcctagtgcctggcacttagtaggtcctcagtgggtctttttaattaattcttttggcacaggtagrctattcacctgatttttaaaatatcaaaaggtatacagtggaatgtcttcctccttaccttttattcatctagttctcacttctccccagtcacctagtc

SEQ ID NO: 3732 - DNA, 201 bp, Homo sapiens
catctagaacagtgcctggcacatagcaagtgctcggtcaatatttgttgaatgaatgagtaaatgaatcaatagtaggtctgttctgatctccctcgatytgggtctgtgcccccatagcaccctgccctaccactgtcatagttcttatctctattgtaatctcttagttgtggcttaggctgctgtaacaagacctca

SEQ ID NO: 3733 - DNA, 201 bp, Homo sapiens
aaaggcttggccatgtcagcccaatgctggaaaacctccagggactgtatttgctgcagagcttctcatggggttggctgaggctgtgcaaggccagcgcrtccagcatctctctccgcccaatcctgcttcctccttggttcttttataagtgttgatccctaggaaacattttgcaccccaaactccattcagtgcttg

SEQ ID NO: 3734 - DNA, 201 bp, Homo sapiens
tttctcttgcccagtgagatgccccacctccccaaaaaatccataaagaagctacataatttgtgtgttttcttgattcttttgacaggctttcagtgggytgggaagcctcgggctcatttctcaagttccagcttcgatcagataactatgtttgattaaacatccttttaaactcattatcagctcagcaatgacttc

SEQ ID NO: 3735 - DNA, 201 bp, Homo sapiens
agaagggggcgggaagggtcccctggaaggtgagtggtggtgttttttgtttggggagctgcactacctccagctcaatcaaaaagagcagatgactcacyggatggttttgtgctgaacaaattaaacccgtcccatcacagcagagcagttcagccaactccatgctgaacttgtgcccatatcatacatttcataatc

SEQ ID NO: 3736 - DNA, 201 bp, Homo sapiens
atccttgtacatctatctttgtgcccttgtgggataatttttcataggtggattgttattgatgtctaagcacgatcgattcagactgtttctcgtggaaygttcaagagatgtaatctctgtcctcagaaaggccccagctagacaaacaaacacgattccactcctgcttttccattatggccctgacctcagctttca

SEQ ID NO: 3737 - DNA, 201 bp, Homo sapiens
aatttcctatttctttttacagaaacctacccttcaggcacatcaaactatttgtggttccctgaatacaccaccctctttcctgcttctccttgcaaacyccattttctctgccttcccccaatcttatcattcaagtctttttaaaattagaaatgacataaatcaaacataaagtggctgaagcagaaaaaaatgtct

SEQ ID NO: 3738 - DNA, 201 bp, Homo sapiens
cccaggttcggtttccctcctatttggtggcacacacctgttgacccagctaggagactgaaatcctcctatctcagtcccctcgctgagtctacaggtawgtgtgtcatcaagcctggctaatttttgcatttttttgtagagacagggtttcaccatgttgcacaggctggtcttgaactcctgggctcaagcaatcca

SEQ ID NO: 3739 - DNA, 201 bp, Homo sapiens
caaaaatcttcaacaaaatatgagcaaactgaattcaacaacatgtttaaagtatcatacaccaggatttgttcttgaagtgaaataatggttcagcataygtggatcaataaatgtgatccgctatgttaacagtataaagaataaaaacgtcatacaataatctcaacagatgcagaaaaatcatctaatatcttctca

SEQ ID NO: 3740 - DNA, 201 bp, Homo sapiens
gaaaatggtaataaataagaaaattcattgttataatattatgtatatataacttaattagcataatagatgtgttatactgtatcactcttcttttctarcgctttgttgcaatagtttgaaactggtaaaaagtaaggactccagaactctgttgtctaagttccgccccccgtccatcacttaagagctataagaact

SEQ ID NO: 3741 - DNA, 201 bp, Homo sapiens
taggacccactattgaaaacaaaatgttataaatatctcatttacaattgcaccagaaacaaaagatagtgaggaataaatttaaccaaggaaattaatgrttggcacactgaaaactgtgaagcattgatgaaaaaaataagacacaaatgaatgaaaagatatcacatgttcatgaattaaaacaattatacttgttaa

SEQ ID NO: 3742 - DNA, 201 bp, Homo sapiens
ttattttcctctgtatttacttcaagagtcttctccagtaatattttgacatttttataaatagctatgtttaagctatttataaaattccaacatcagcrttgtcttgtcattcatgtctgctgattttcttttgtgatatatgtaaagattttcttggttcttgttttggtatgcatttttggttttaccatgtgcact

SEQ ID NO: 3743 - DNA, 201 bp, Homo sapiens
ttgtggttttgatttgcgtttccctaatgatcagtgatgttgagctttttttttcatatgattgttggctgcatgtatgtcttctcttgctataaaatctwaaggaagtgtgaaatgtattgtttttctgacttaaattttcacatttttaggccacattattttttaagatggttgaagtttattcttagacaacaaata

SEQ ID NO: 3744 - DNA, 201 bp, Homo sapiens
ttactaagaaaattaaaaccatgaaaaagaaacaaacagttatcttggactcgaagaatacaataaatgaaaacttaaatagcttaactgcaaaattaatwaaacagaagaaataatcagtcaacttaaagacagatatatttaaaattagccagttagaacaaactaagtccaaagttagtaagaagaaaaaaagaataa

SEQ ID NO: 3745 - DNA, 201 bp, Homo sapiens
atttttgtgggtaaataataggtgtatatatttatgggatacatgagatgttttgacacaggcatgaaatgtgaaataaacacagcatgaagaatggagtrtccttccccttaagcatttatccattgagctacaaacaatccaattacaatctttattttaaaatgtacagttactattgactataatcatcctgttgtg

SEQ ID NO: 3746 - DNA, 201 bp, Homo sapiens
cattttctgtgaaattataactaattttcaattattgtaataaggtaaatataatcataataaataagcttgaaatttatatttcataacctataatttargctttcagaaaggttaataaaggacttctttcagagtagatagaaagttcaggattcagagaatccttacagaagtcaaaaatacctcagagaacagtgg

SEQ ID NO: 3747 - DNA, 201 bp, Homo sapiens
gattgataatgtgtggggttgccataacaaagtaccacagactgtgtagctcaggagggcataaatcccagatcaagttgtcagtggaggtggttctttcrgaagcctctatccttggcttgcaagatgaccatcttttccatgtgccttcacacagtcttccctctgcgtgtgtctacatcctattctcctcttcttata

SEQ ID NO: 3748 - DNA, 201 bp, Homo sapiens
tccctttgggcctaattttcctttctacttcccctttcccctgacttcatacctaccctagactatgacatttacaaggaacttgtgaaaagtgtccaaayaccacaaacataacacaaataatgagctatatatacagaaagtttttacttgttttgcaggtgtcatgggactctagaaacatggtcacatcgaagtgaa

SEQ ID NO: 3749 - DNA, 201 bp, Homo sapiens
tgttttgcagatcccaaataacgggattggctttcattaaatgtactaccaaaaaacaatctacttatcttgtataaaataatttttaatgttgagaccaraaataaaagtaattatcatagctaggtcaactgtcattattttttctgtgataaacaatgtatattcatatatttctccttatttcacatacttacatat

SEQ ID NO: 3750 - DNA, 201 bp, Homo sapiens
aaataaaaagaaattattgttaatgactagcaagtagttaataaatgtaataacactttaaatatatttgctataaagtttgtaaaatttgatatttaatyaaagatagatgcctctggatgtccaacaagatagtaaagtttttaaaattttttaaggtattcccattaaatatattatttttttttaaaaaagagaatg

SEQ ID NO: 3751 - DNA, 201 bp, Homo sapiens
ccaaaattacaaataaaatgtgaatttgcagttattcatataaaataatatagtttacaatattaacataatgttacaataaatattatgcctatccttcktatttaatacactcctggccttgcagagttctgcactatgaactatttgtcctcatttttctaaatgtcatttttggaaaaatcacattatcacctgtat

SEQ ID NO: 3752 - DNA, 201 bp, Homo sapiens
atgataagtaaaagctatataattatctctacttatgtgtataattttgccaactgttttaaacatttgatttaatcttttattttaaatgaaataactayaagttgtttagtattctagtgctgtacactggctacttttttgaaatactcgaaaaagcttttcactctggaatcaatttttaaattgccattaaaattt

SEQ ID NO: 3753 - DNA, 201 bp, Homo sapiens
atattagttcaaatatattttgacttcctctcatatttaagttattattaagaaattcaaacaacatttgaaattgaatcaatactgtatctataaaacayatttgaaaaaatctgagatttatatattttatatttttatattaacttatttcccatttctaaatttttttttcctgaggaaaatggaatttgtcacagt

SEQ ID NO: 3754 - DNA, 201 bp, Homo sapiens
acagccaagccatatcaataatattagtttataagtaaacgttccttatgtgaagaaaaaagttttacctgaaaatactattattttagatgtcattgatrccttaaaatttagatgtgtacaagcttattgttgtttatgaattataatcttgtttctacctattcagtaaatttaacaaatctctatattagttcaaat

SEQ ID NO: 3755 - DNA, 201 bp, Homo sapiens
attatgggaactataattcaaaatgaaatttgggtgggaacacagccaagccatatcaataatattagtttataagtaaacgttccttatgtgaagaaaamagttttacctgaaaatactattattttagatgtcattgatgccttaaaatttagatgtgtacaagcttattgttgtttatgaattataatcttgtttcta

SEQ ID NO: 3756 - DNA, 201 bp, Homo sapiens
ctggcctgatcatcgaatccctgaaggaactgctaggagaaagaaacagaacatcaaacatagtgaaaagatcacttttgatgagattgtcaacatttccyaacacatgcattgctgatctttagccagagagtcttctaaaaccattaaagatattctcggtactacccagaatgtgggctacaccactgttgctgccac

SEQ ID NO: 3757 - DNA, 201 bp, Homo sapiens
tgctaatatctacagtaagagtgaattttatatctgtgaaactgtgaatgttaagaatatatttgtcctcaaggtctcctatacatgcagtggatttaacrtaccatatgatccagcaatcccattattggatatatattcaaaggaaatgaaatcagtctgcaaatccaagtatgttacagcactattcacaatagccaa

SEQ ID NO: 3758 - DNA, 201 bp, Homo sapiens
tattgcaaatattaaaaaaaaaaaaagaaacctgtcatttaactagaatgtaacaaatacagccccatgaatcagaaacctagcctaccactttgttgctrgtagatactgatcatgattacctcagtggcttttaaaatattttaatagaggcaatcatttttaaaagacaatttttgtatattttggagcagttttaga

SEQ ID NO: 3759 - DNA, 201 bp, Homo sapiens
atcttttccttaaaagacaaactgaaagttgcagtgatctttatctccaggatttatactggtactctggaaaaatacagcaaagaaaattaataaatcargtattgtttagtagaatagtcttatcttccaatgataagtaaaagctatataattatctctacttatgtgtataattttgccaactgttttaaacatttg

SEQ ID NO: 3760 - DNA, 201 bp, Homo sapiens
gtggagggctaaggctggaggattgcttcaggccagtagtttgagactgatctgcacaacatagcaaggcatgtttatacaacaacaacagcaacaacaasagcgacaacaacaagccgggcatagtggcacacatctgtagtcctagctactggggaagctgaaggaggagaatcacttgagcccagaagttcaaggctg

SEQ ID NO: 3761 - DNA, 201 bp, Homo sapiens
tgtgaacatcaaaagcctcttctgcaaatggatgatatacaccttattggtgagggaggaagttggtatctatctattctaactggtttattgaacatacyggtgtttgtgaggtgcaagcagtagagaaaaaacacattatttgctcacaacactaactttctttcgtgctactttgaatctccactttctatgctttca

SEQ ID NO: 3762 - DNA, 201 bp, Homo sapiens
ctatgtgtaagagtctttgttagtaaatgcacaaaatatctttggaaaaataaattaaaatttggtgacagagtttgtcactaagaggaaaaactagggartgggtggaaaggagacatatttttcactgtatatgctttgttatgttttgaatttttttaccatgtacatctattaatcttccaaaatgcaaattaatag

SEQ ID NO: 3763 - DNA, 201 bp, Homo sapiens
tgattttggttctttaatcttttttttggagaccgtcttgctttgtcgcccgggctggagtgcagtagcgcgatctcggctcactgcaagctccgcctcaygggttcacgccattctcctgcctcagcctcccgagtagctgggactacaggtatccgccacctcgcctggctaattttttttttttttttttttttttgt

SEQ ID NO: 3764 - DNA, 201 bp, Homo sapiens; identical to SEQ ID NO: 2054

SEQ ID NO: 3765 - DNA, 201 bp, Homo sapiens; identical to SEQ ID NO: 1623

SEQ ID NO: 3766 - DNA, 201 bp, Homo sapiens; identical to SEQ ID NO: 1624

SEQ ID NO: 3767 - DNA, 201 bp, Homo sapiens; identical to SEQ ID NO: 1625

SEQ ID NO: 3768 - DNA, 201 bp, Homo sapiens
gagacagagacagagagagagagagagagacacagagagagacagagagagagcgagcgagcgcgcggcagccgcggggcgagggcctttgctgctctgcyggggcctgctgactgaaaggaatttgtgtttttgctttttttccaaaaagatctccagctccacacatgtttccacttaataccagagaccccccccctt

SEQ ID NO: 3769 - DNA, 201 bp, Homo sapiens
gccccgcacccccgaaccgaccaccgatcgaccggcaccgctgttgcctcgtaagccatagcgcatgcgcgctctcaggataaacaggccctgcctgggayccacacgcctctgtcttttctgagcctcctccccgtggggtgagaggggtggagggatgaggctgtttcagggagccccctccccgagtctcagcagctg

SEQ ID NO: 3770 - DNA, 201 bp, Homo sapiens; identical to SEQ ID NO: 3670

SEQ ID NO: 3771 - DNA, 201 bp, Homo sapiens; identical to SEQ ID NO: 3671

SEQ ID NO: 3772 - DNA, 201 bp, Homo sapiens; identical to SEQ ID NO: 3672

SEQ ID NO: 3773 - DNA, 201 bp, Homo sapiens; identical to SEQ ID NO: 3673

SEQ ID NO: 3774 - DNA, 201 bp, Homo sapiens; identical to SEQ ID NO: 3674

SEQ ID NO: 3775 - DNA, 201 bp, Homo sapiens; identical to SEQ ID NO: 3675

SEQ ID NO: 3776 - DNA, 201 bp, Homo sapiens; identical to SEQ ID NO: 3676

SEQ ID NO: 3777 - DNA, 201 bp, Homo sapiens; identical to SEQ ID NO: 3677

SEQ ID NO: 3778 - DNA, 201 bp, Homo sapiens; identical to SEQ ID NO: 3678

SEQ ID NO: 3779 - DNA, 201 bp, Homo sapiens; identical to SEQ ID NO: 3679

SEQ ID NO: 3780 - DNA, 201 bp, Homo sapiens; identical to SEQ ID NO: 3680

SEQ ID NO: 3781 - DNA, 201 bp, Homo sapiens; identical to SEQ ID NO: 3681

SEQ ID NO: 3782 - DNA, 201 bp, Homo sapiens; identical to SEQ ID NO: 3682

SEQ ID NO: 3783 - DNA, 201 bp, Homo sapiens; identical to SEQ ID NO: 3683

SEQ ID NO: 3784 - DNA, 201 bp, Homo sapiens; identical to SEQ ID NO: 3684

SEQ ID NO: 3785 - DNA, 201 bp, Homo sapiens; identical to SEQ ID NO: 3685

SEQ ID NO: 3786 - DNA, 201 bp, Homo sapiens
gcccagctggtggtgagtgagcaggtgtctgggctccaagccttctgggagctggtggggaggaagagcaggcagggcactgggcctgcctctgaaagggyggatagaagatgccgtggatgaaggcgccttcagggtgggggagccagtccagcctgagccagggccctagggaagttgcgggagggggcagggtgtggt

SEQ ID NO: 3787 - DNA, 201 bp, Homo sapiens
agactcttatatctaactactgtctgtgtataaagtaacagacaatctgagacatgcgaagactcaaaaaatccaccgtccatccacccttcccccaaggkttactcaaagtagcatttcagtggtgtgagaaattaatcaaagtaaggaactcaggaatgaggaagtcatttacgtaaatgaaatgacaataaacaatgt

SEQ ID NO: 3788 - DNA, 201 bp, Homo sapiens
aaagaatcaaaaagattttttgattctacaaaaaaattgaaaaattagccaggcatgacagtggtcccagctacacaggaggcgacggttctctatttatyccttcagtcattttaatggttattgggggaggtgtgtcagtggaccatcttggaccaaggtttggatcccttgggcccaagagttcaaggcttcagtgaa

SEQ ID NO: 3789 - DNA, 201 bp, Homo sapiens
tggatttaagaaccggcagcttagcctgaggaattgctgtgttctgtgggagcagggcaggttcataaataagtgcacagaggtcttgaaatacagggatyatctgttcttctcggaacatggatgtccttccagggatgtgcatctggccttgctgtctaagttccatcaagggagccttccgttctctgtagcgacaag

SEQ ID NO: 3790 - DNA, 201 bp, Homo sapiens
aagagcatggcttcagccaggccccctgggttcagtccttgctctgccactggctgtggaacaaggacaaattagttaacctctgggcccgtttccccatmtgcagagcaagaataataatagaacccccatcaactgttagatgatcttggggattaaggtagggctccaagtgtctcacacagagggagtgctcaatac

SEQ ID NO: 3791 - DNA, 201 bp, Homo sapiens
caacaaccaagtgagggagtttatgattcccagtttacagattaggaagtagaggtcttgagaggccaagaaatttgcccatggtgacatggctaagaagygggaagtcaagtgttaatgtgggtctctgattcctaagtcaaagcctggccttggttgaatcctatgccttgggtaagcaactgctacattctccatatg

SEQ ID NO: 3792 - DNA, 201 bp, Homo sapiens
tgagggagtttatgattcccagtttacagattaggaagtagaggtcttgagaggccaagaaatttgcccatggtgacatggctaagaagtgggaagtcaartgttaatgtgggtctctgattcctaagtcaaagcctggccttggttgaatcctatgccttgggtaagcaactgctacattctccatatgtggcagggtca

SEQ ID NO: 3793 - DNA, 201 bp, Homo sapiens
agcgtcccaagggtgccccacttacccacagaagaagaaaggcaactttgtaagagatctgacttctagctccagttctgtctctagctaacgtgagatgyacccgtttgaggcctgttttttaattttgaaaatgaaggactgaacttagatggtccaactgaaatgttttaaaatgatatgattctaccttaaaaagag

SEQ ID NO: 3794 - DNA, 201 bp, Homo sapiens
ccatagagggaacagagccagaagttcctcaggggccctttttctgtcctggctgggccagaggctggtgtcaacagccaaatgatgaatcagcccaacgstaatgttgagccattgtgtcaacttccatgcattgagtgaggttgaggacagcacccccaatgcaaatctgacctgcaaggacccaaaggaccccgtgat

SEQ ID NO: 3795 - DNA, 201 bp, Homo sapiens
catggtagaggaaaagagaaagagtgtagacaaaaacagttgaagaacatctgtgcttgttccaccttcattttctgttttgtgcgttgcctgaatgaacsgtgtcttcaggttggtatttcacaggcggtgctcccaagtagtctggttttcccatttgtggagggcgaggtcatagaggggacagggggaggctgtctg

SEQ ID NO: 3796 - DNA, 201 bp, Homo sapiens
taacttaactttttcatataacatggctttataaactttttctgaaaacttcttaagcataattgtccaattagctactaaataattgttaaatggatgtrcaactattgacttcaccaattccttactttaaaaatgtaggtgctttccaagtttttgctcttttcaataacaccaccggtatcctctttgggaataaag

SEQ ID NO: 3797 - DNA, 201 bp, Homo sapiens
tccactggctcccggccacatgaggtgcatgggatctctgccaaggctgtaagacccagggcctggggtccagcctatctgggtacccagggcctgtagtstagccttcctgggtgccccaggcatcagccatttccctgacagactctccatcacctggaggcagagagtggatccctgcagctttctctttctagtttt

SEQ ID NO: 3798 - DNA, 201 bp, Homo sapiens
ccacgagggtccctgcagctgtgtcactgaggcaaacaggaaaagtgattttggctaggcgtggttctcatctgtgaaattccacagcgcaatgacagcarcctctctcccacccactcaagacactgtcaggaatgtcttaagacctcaggagaccacttctttagcaagcaattttgttttttgttttttttgagatgg

SEQ ID NO: 3799 - DNA, 201 bp, Homo sapiens
ctgctcggttctctctgtgacttcagaggcccaaggagtcctcagcactatagatgcatgtggcccctcagaagacaacatttcacagatctgcaaagagyaaaggtcaaatttatttaatacaacatccacgagggtccctgcagctgtgtcactgaggcaaacaggaaaagtgattttggctaggcgtggttctcatct

SEQ ID NO: 3800 - DNA, 201 bp, Homo sapiens
atcttggagggagtctctgtcgtgacagaggactggccgcagagtatagaggcctgggctctgttcctcactctattagccatccaggtgaccccagacaygctattctaccagtgcaggcctcagtttcctcatctgtaaattgggctccttgtcccagtgacacgatagtctctgatttcaggagtctgagtgggtttt

SEQ ID NO: 3801 - DNA, 201 bp, Homo sapiens
caccaccttcttggcaggcgccatgctgtgtttgcctggccctgccagtctgcagttgcgcaaatggtcccaaccggatgtcagcaagaggacagtgaggstgagaaaagccaatgagagcaggaagctctgcataggtggtgggtgatccctgcctgcattcattagagatggtgtttcctatgagaggcaagtgacggg

SEQ ID NO: 3802 - DNA, 201 bp, Homo sapiens
aaattgcaggagagaatattcgaaatcagaactggccaaggctagtcagagaagcccagggcttctggtctgaaacagactagggagcggggaagaattcrtgtgaatgcaggacgtgggtgagtctggaaatatttcactgttcagtggagtacttttaaatataatgtatatgaaatgtgtacttacagagtatctgct

SEQ ID NO: 3803 - DNA, 201 bp, Homo sapiens
aagtgatcacatgtctgattccctcatcagaaggtgaactgaggtcaagaagcttgggtgtctcctgcagctgatggcctggtgtgtagggggtaattagwatcggctaaattgcaatgagctgtcagctgctccactcctccaagcatacaccctagatctgcctcacttccagagcctagactttggcgttaaacgaaa

SEQ ID NO: 3804 - DNA, 201 bp, Homo sapiens; identical to SEQ ID NO: 2906

SEQ ID NO: 3805 - DNA, 201 bp, Homo sapiens
gggggactctgcagcccctccagacatccctgctacgaaggtggaatatcttgattgtgcgtggatttcgttatcacccaggtagctgcttgccattgtawctgacttctcctttcagctctttaattggttaaaatgttctaagacctccttcatgttgcgtccagcctcagaaaacagatcagagttgtcctccccaag

SEQ ID NO: 3806 - DNA, 201 bp, Homo sapiens
cctgatttggaccctgggctccagccaagcctgtttcttcactgtccctgtcacatgctccctgctcccctgggcgatcacatttgctcattctgtactcyagtccctacttttgtccccagtcctggttattgtccccaaggtcagactgaaccccacctcatccataatccccacctccagatctcttgggaccggaag

SEQ ID NO: 3807 - DNA, 201 bp, Homo sapiens
tatcttctatcttcttgttccatgccacgggaagtaggtcacaaggaggggaattaggtcagaaacagcgggcgtgaggaggcggaggatggagaagggcrtgctttccacaggaatcttcgagatccaggccactcctctctctccactgagggggcgtgagacagattctgagccaggctatggcagaatccaatctga

SEQ ID NO: 3808 - DNA, 201 bp, Homo sapiens
ggaagcatgctggcgggaagctgtgcatcatgggagctgagaaaggggaaaacagcctggcctgggcttgaaggaggggtgagaggagccagcaggtgaayggagctaaggatcatgaaatatccccgagggcaccccagcaccaggcttgtcttcctcttcctccaggaggggcaagttataggggggtccattgagaga

SEQ ID NO: 3809 - DNA, 201 bp, Homo sapiens
tcccgcgaatgaaagtgtaaatcctgtgagatccattccctggtggatgagacctattttctcatatttcctccttagcaactcgtgcagagctaagtgcrcggtaagggagtgtcagggcttgttggctgactcttgtgtccagagctcatcagagaatgactccggctctgctccagcttctttgaaagcgaggctttt

SEQ ID NO: 3810 - DNA, 201 bp, Homo sapiens
gggcctctaggagttgacctgaggctgttaagtgagatctatttacaggacttgtggctaataggagtttagaaacttcttttgggctctacacagcctgrctgtcaaaggtgtatttttcactgtccaaagtctgaaagtcaggctctgttgaaggacatgcttgtgacatcaagtgggaaacaatggtggtcattcttg

SEQ ID NO: 3811 - DNA, 201 bp, Homo sapiens
agtgtttgttgagtgaacgagtatggaaaaagccctttggatgaggacctgagcaaggaagaaaaatttgcctccatgatgctagcatgaagcatctttasccaatgtgacaccatttctcatctgaaatacattgtatctggcctgaaatgctaatgatgtcaaaattaaacatacctatgagaatagaaatttttttct

SEQ ID NO: 3812 - DNA, 201 bp, Homo sapiens
tgacacttaaaataaaactgctataaacattcatgtaaagtttatttatgtggatgtatggtttcatttctcttggttaaatttctagaaataggattgckgggttgtatgctaagtatatatttaattttacaaggaactgccacctgttttctatggctgtaccactttgaattcccaccagcagtacatgttgttctg

SEQ ID NO: 3813 - DNA, 201 bp, Homo sapiens
agctttgaatgaaagcaccttcctctctatcatgttttctcaattgtcctcttatcatctcattccattcattttcccaaagctgtcttagctgctctatwtttttttgaagattttaaatttaatttttattatagtaaaatatgcataatgtaaaacttaccaaatgaacaatgttttttttttttttttgagacggag

SEQ ID NO: 3814 - DNA, 201 bp, Homo sapiens; identical to SEQ ID NO: 3001

SEQ ID NO: 3815 - DNA, 201 bp, Homo sapiens
taccttactaaacataagataattcattctggagagaaatcttacaaatgtgaacaatgtggcaaaggctttaactggtcttcaacccttacaaaacataraagaattcatactggagagaaaccctacaaatgtgaagaatgtggcaaagcctttaatgtgtcttcacaccttactacacataagatgattcatactgga

SEQ ID NO: 3816 - DNA, 201 bp, Homo sapiens
aaggcagaagtagttgtccaacagcttttgttaatttccaagatccatccatattgttcattacatttccatatcaaaataacaaactgtagagcaaaagkctcatggcattctgttgacttaaaagttaaagcagagggaagtgcccatcaatgcagtaagagagcaggtttagccagaatgagcacaggccagccaatg

SEQ ID NO: 3817 - DNA, 201 bp, Homo sapiens
ttggagcggaggcctggtgtcgggtggggggtgctgtgtacccccacttcctgcacttcaggtctgagaaccattagcaagtcctgttttttctccaaacycccaccttttgctgcctttgtggcctggcagaatgttttgctgccactttcttgagtgacaacttcaaagctaagcagtgagatgctttaacctacacat

SEQ ID NO: 3818 - DNA, 201 bp, Homo sapiens
ttttttcattgaaccaaggcagaagtagttgtccaacagcttttgttaatttccaagatccatccatattgttcattacatttccatatcaaaataacaarctgtagagcaaaaggctcatggcattctgttgacttaaaagttaaagcagagggaagtgcccatcaatgcagtaagagagcaggtttagccagaatgagc

SEQ ID NO: 3819 - DNA, 201 bp, Homo sapiens
gtaaggcatgtatgcatctctagagtctccagatggtcctggatgtgtgaattctgcccattgctggccgtgaacattcaagggtacggcatgatgtcacrgctgagtcacaggccgaggagttcttgagaccagagctgcattccaccctgccacttgcagactctgtagcttatgcaaattacttagcgtttctgaaaa

SEQ ID NO: 3820 - DNA, 201 bp, Homo sapiens
cacccatcatcccagcaggcttctgtttccttgcagcaggactgtctgagaaattaaggtagccaaaaataatctaacagcaaccaccagttgtcaggtgmtttgctgagctttgcagggatggtctagatgaagtctcatagccattccatgaggtggagaactggacgtaccgctctgtcttccccacctgggcactag

SEQ ID NO: 3821 - DNA, 201 bp, Homo sapiens
ggagggaaagaacaaaatactcttaaagtagaagagcttctgtagaggtccctggtgtctccttgctccctgaggacagccacagctctggcatctctacrtagttttctttgatggagcctgcactcctgcaacaaaagggcctcaggtgagctctccatctgtggggcttaccccacgctctctaagggcttgggggca

SEQ ID NO: 3822 - DNA, 201 bp, Homo sapiens
catcctaagactagagaccagtcctggaaaatattcagaattggataaatgagagaaatgggaaatggatggctaccttgagctgggacctgactgtgagragggaagtagtgtgtaaagggtctcagagaggcttgaatgttgggctaaggattgtgatgttgtgtgatgggtgaagggaagccactggagacagtgacc

SEQ ID NO: 3823 - DNA, 201 bp, Homo sapiens
ctaaggaagggaggtgagcacttctcgctgggagggattttcagctcatttcacagataaaatcaatcagatctaaaccacattcattgtggccatgagargggagtctacacagcaggggccaaatgggagatcctttcctcccttcccatctggctctgccttagcctgggggcagcaggagccccaggcctccaggct

SEQ ID NO: 3824 - DNA, 201 bp, Homo sapiens
tgatcccacagactccgcctatctgctctccccaagcccccacgcagcccacacgtgctctgggtggtgggcagcctgatttatctggagtgtctgggctraggaagggaggtgagcacttctcgctgggagggattttcagctcatttcacagataaaatcaatcagatctaaaccacattcattgtggccatgagaagg

SEQ ID NO: 3825 - DNA, 201 bp, Homo sapiens
atacccctgtgaattccccttgaagggttggccaatgagtggcacccataatggctcatttcttcactgcatttcagtttgcaaacttatcttcccctggrttatttctttgcacccacataagagccttcgaaaaatgcatgcaggatttagccctcactgcacaagggaacaggggcacagtaaaatgtcccaccttgt

SEQ ID NO: 3826 - DNA, 201 bp, Homo sapiens
tggtaggtgtggtcctagtaaggagcgttttgagtacagaaaatgcaacactccccaagcttgcttaagcaagacaggggttacctgggggtctatagagwtattttccaggggacatgggtaggaaatgcccccgggaagcagggggcctggaaacaggaattgagatgttccagtcaggaaatacagccacctgtgctg

SEQ ID NO: 3827 - DNA, 201 bp, Homo sapiens
cttgagaaacgccgttaagtggtttctcagatgacagtcttgcgagattaagcgatcggttgtgctccaagttgaccagctggaaaatgccctctcatgtkgacttcacctccttcctcacctcaattccctttgctctcgcttctgcttcctaggttcgtaccctctggcactttggcagcacgtgagctatgtgggtgc

SEQ ID NO: 3828 - DNA, 201 bp, Homo sapiens
tccatgcccagcaggtactttcagaaggacttgaggatataagggaatgggtcagggaagtgtggtacaaaaaaaaaaaaatacttgtttgtttgtagctrtgccaagatatttcaaacccaaagcctgcctggatcaaacacgtgactttgtctccatggtatgtcagatggcaggtgggccaagcctgaagaggccaag

SEQ ID NO: 3829 - DNA, 201 bp, Homo sapiens
actttcagaaggacttgaggatataagggaatgggtcagggaagtgtggtacaaaaaaaaaaaaatacttgtttgtttgtagctatgccaagatatttcaracccaaagcctgcctggatcaaacacgtgactttgtctccatggtatgtcagatggcaggtgggccaagcctgaagaggccaagacctcctcctgctcca

SEQ ID NO: 3830 - DNA, 201 bp, Homo sapiens
tcctgcttcatgtggatccagagccttgaaccctgtaccatccacagggcctccagcatgcaggctgacaatggctgggtgcctgtgggcattttgggaakccctgtgtcattaaaggagctgggagacaactgctctacagagcattgagaagcatatttcattttccaaatgctttaaacatcacccctccgttttgca

SEQ ID NO: 3831 - DNA, 201 bp, Homo sapiens
tcattttacaaacactttttattctttcttgctagcctgatgagtctttagtggtgggttattgtgaataatatgtgattttaatgagttgtgattagacraaactctcttcctataataaatactagataataaattagaaaatatatatgagatctttattcctattttaaaagggtgaaagacataaatgcaaaagct

SEQ ID NO: 3832 - DNA, 201 bp, Homo sapiens
ggactgatttatagacattgggaaaaggaaagagatgttcccaatatttgttctccctcctccatcttatacagagtcccttgcctccctctttattcctsccacgtgtttacttgtggagatttatgcagactcacccctgacccaggggatggcagtatcagactcaccatcggaaggtttggttaatcacctgatatt

SEQ ID NO: 3833 - DNA, 201 bp, Homo sapiens
gatttcgttttgggggagctggaacacctgtccactgatcgcctgccactccgcatctgggcctggctgacaggcttgtctgctttgactaatgatgtgaytgatggacaaaataaggaagaacatacaaaaaaacatttctgtctggtctggtgtgtcagcaagccttcatcaagtggctgctgaaggtatattttgctg

SEQ ID NO: 3834 - DNA, 201 bp, Homo sapiens
taatatttttccagatgcctcctctcctaccttttgtccttcccaactgccattcactaaagaaagactctttggaaaatgttggcctggaagcatgtctrttcctattctagtttctggatcctgtcaacaatttttacttgtatgattgtctcattatttttattattttaattgaagtggtggcattatgcaatttgg

SEQ ID NO: 3835 - DNA, 201 bp, Homo sapiens
aggttgcagtgaggcaagatcatgccccattgcactcctaaaatgtgttttcttttgggagaggaggagagagtataatgttgccttgaggataaggcaaktctctcactattgcgtttctctgaccctatacggagaggcaatgaggacatgcagttcagtggtgaggagtgtatctcagggcaagcctcttgtgtgggg

SEQ ID NO: 3836 - DNA, 201 bp, Homo sapiens; identical to SEQ ID NO: 2747

SEQ ID NO: 3837 - DNA, 201 bp, Homo sapiens; identical to SEQ ID NO: 2750

SEQ ID NO: 3838 - DNA, 201 bp, Homo sapiens; identical to SEQ ID NO: 2751

SEQ ID NO: 3839 - DNA, 201 bp, Homo sapiens; identical to SEQ ID NO: 2752

SEQ ID NO: 3840 - DNA, 201 bp, Homo sapiens; identical to SEQ ID NO: 2753

SEQ ID NO: 3841 - DNA, 201 bp, Homo sapiens; identical to SEQ ID NO: 2754

SEQ ID NO: 3842 - DNA, 201 bp, Homo sapiens; identical to SEQ ID NO: 2755

SEQ ID NO: 3843 - DNA, 201 bp, Homo sapiens; identical to SEQ ID NO: 2756

SEQ ID NO: 3844 - DNA, 201 bp, Homo sapiens; identical to SEQ ID NO: 2757

SEQ ID NO: 3845 - DNA, 201 bp, Homo sapiens; identical to SEQ ID NO: 2758

SEQ ID NO: 3846 - DNA, 201 bp, Homo sapiens; identical to SEQ ID NO: 2759

SEQ ID NO: 3847 - DNA, 201 bp, Homo sapiens; identical to SEQ ID NO: 2764

SEQ ID NO: 3848 - DNA, 201 bp, Homo sapiens; identical to SEQ ID NO: 2765

SEQ ID NO: 3849 - DNA, 201 bp, Homo sapiens; identical to SEQ ID NO: 2766

SEQ ID NO: 3850 - DNA, 201 bp, Homo sapiens; identical to SEQ ID NO: 2767

SEQ ID NO: 3851 - DNA, 201 bp, Homo sapiens; identical to SEQ ID NO: 2771

SEQ ID NO: 3852 - DNA, 201 bp, Homo sapiens; identical to SEQ ID NO: 2772

SEQ ID NO: 3853 - DNA, 201 bp, Homo sapiens; identical to SEQ ID NO: 2773

SEQ ID NO: 3854 - DNA, 201 bp, Homo sapiens; identical to SEQ ID NO: 2774

SEQ ID NO: 3855 - DNA, 201 bp, Homo sapiens; identical to SEQ ID NO: 2863

SEQ ID NO: 3856 - DNA, 201 bp, Homo sapiens
gggcagaggcccatgtgcaaaggtctcaggaacttgaattccctgtagttttagtaactaatgttggtatagattttgatggtacaacattttttcacatkcatctttccactgaggttgatatacaaatattaccgtccccaaattagagatgaacaaagagatttcattacttgtctaaagctgtatcactccctgcat

SEQ ID NO: 3857 - DNA, 201 bp, Homo sapiens
atacctgagtcaaggggatacattattattgtgcttaactagagggccagaggtgggcagtttccagctgcagtgcaggaatgagtaagggaagaggaaaraaaggaaataggaagcgcttctcactacagtgcaattctgaggtggtctcagccagtccagtgtggagccccagggcaaagattccgtcagacaattcag

SEQ ID NO: 3858 - DNA, 201 bp, Homo sapiens
gagagactaaaaaggagcatttgcagtagtgagaaaaccaggcaaagaggagttgaggagttaggaaactaaaccagcgtactaaacagaaggagtggtcygaagtgtcaaacgctgttgattgtggcagaataaacagcagtggtgaaatgaagacaggaggtaggttataggtgagagaggagtgaagtgctaatgtct

SEQ ID NO: 3859 - DNA, 201 bp, Homo sapiens
taaacctattttgtaagtgaattaggtcttaggagagaatcagaaacgatgttgttcttttagccgcttacagtgtttgctttaaacccttgataggaacrtgggcttgtgacagcagcggcagaggtaaacagatgactttatatataatgctttttacaaggtggttcagttcgtttctaaccttggtctcggcgtcat

SEQ ID NO: 3860 - DNA, 201 bp, Homo sapiens
gaaaaccaggcaaagaggagttgaggagttaggaaactaaaccagcgtactaaacagaaggagtggtccgaagtgtcaaacgctgttgattgtggcagaawaaacagcagtggtgaaatgaagacaggaggtaggttataggtgagagaggagtgaagtgctaatgtctctttctgtaatagatgctctacctagaaaaaa

SEQ ID NO: 3861 - DNA, 201 bp, Homo sapiens
tgattgcaggactcttggcagtactagtgtgagttgaaacaatgaatgaatttgccagatctgatcaacagtttcaaggaagagtggactcactaatcttygagatctgggaaaaccttgagtggggccttcgtgttcctatctttctgagttgaagaaggaactcatccttcatctccaagtcaatggtaccagtggctt

SEQ ID NO: 3862 - DNA, 201 bp, Homo sapiens
tttatttttcacaaaggtcatagctaaatcaggtttatttgccatggaagagaacagtctaaatgaagtacacttttagttctttagtaaaagggaatgtyagcaaattttaacaagcaccactttaaatttttacaccattagacatgcggttttgctttgtctagttatacccttctttatttccctctctaccagatt

SEQ ID NO: 3863 - DNA, 201 bp, Homo sapiens
tagagctgtcaggacccagcagagaccaggaagggattcctaaaggtttgaagtctcagagccaagggatggggactctggtcaagaaagaacgaggtgtyccatgctggtggctacagaggacagaatctcctgtcaagaacatgtcaggatcctcacctggggatcctagagagtggagcccaaggccacctgctctgt

SEQ ID NO: 3864 - DNA, 201 bp, Homo sapiens
gtcgttataatgtctggtactccagcagtaattttggaccatgaggtgatcatagggatgggagctgtacatggggaagcaacaaggcagagggagcctgraaccctgcccctctgtccaccatgtcaacttgggcctcccagtgccagacttaggaaacatcacccactgttattttgggttttctatccttgcagtcaa

SEQ ID NO: 3865 - DNA, 201 bp, Homo sapiens
tttgtaagtatcctcttaatggtatactatttcttcatataggtatattgtaattcacttaaccaactcctctctgctgaacattgcggttattgctagtkttctcactgttttgaataaagaggcaatggatacctttgagtatgaaaaaactttccctcatgaaacttccataatctgaaaagctatccagaaacatgg

SEQ ID NO: 3866 - DNA, 201 bp, Homo sapiens
ccaggaaaagcctaacaaaagtctctggttccatccgagcagctgcagaaaagtcttcaagaatctgagtcttctaaaagctgcctccataatgaactagwcttagtgaagagagaaaacatagacagtgtcaatcatggccagtgacagggtgcaattaacccaggatcaaattgcagcaagatggatggggccagatgg

SEQ ID NO: 3867 - DNA, 201 bp, Homo sapiens
ggaaggccattttaaaaaatttagattccattgtaaatggaatgggaaattgtaagaggtttaagcaggtgagcagtatactatacctatttagcaggagrctgtttctacattttcatggaaggaagtcagcatagggttgttctgtagcagaagacagagaagcagaaatagctgactttgctgatgttatggtctagg

SEQ ID NO: 3868 - DNA, 201 bp, Homo sapiens
taataataaatgatggtgataaagatgatgaaaatgatgaagatggtgaagctgaccagaatgatgatgatgaaaatgataatgatttgaagacttcaacytcattcagcttcctcagactagtatttattattgtaaggttttccatgctgacaaagaggaggaaaattccaatcataagacaatattctttctattaat

SEQ ID NO: 3869 - DNA, 201 bp, Homo sapiens
actttaaaaataacctatttaagtataactttttattatggaaattatcaaacacatactaaagtaaaaagaaaagtataacaattccccttgtacctcaycatctagcctcaacatgttgccacttttatttcatctttgactcactaatccgcccactccccatcttgtttttcctggtatattttaaagaatatccca

SEQ ID NO: 3870 - DNA, 201 bp, Homo sapiens
cttcatgagagcagaaactatgttgttcttgcttgccactctattaccacccctggcccaacagtaaatatctgttgaataagtgagtttctaaaagtcayggggtggaagctggatgattctgagtggtttgcaacataatagtatttatcgcactgtaagttgagctggtcatgtgaaccatccagcaggaagcttgtt

SEQ ID NO: 3871 - DNA, 201 bp, Homo sapiens
gaatcttgctatgttgcctaggctggtcccaaactcctggcctcaagcaatcctcccacctccgcctcccaaaatgctgggattatggcgtgagttactgyatctggccttgttatacattttaaaaatttttcttggatcttggctttgaaactcaaaagctgaaactttgacatttttgtccttcagctcctctgcaat

SEQ ID NO: 3872 - DNA, 201 bp, Homo sapiens
cattcccaaagttgttggccaaataaaacttttctgtaggcagaatttgggctaagagaatccagtttgcaactcttgaaatggagacattcgcttagctrttctttggtttatggtgcaaatgatgatttgtttcactcctgtttgtgtgtaaccgaatgggaaggctcaaggtatctcttgctttgtgaacacctctct

SEQ ID NO: 3873 - DNA, 201 bp, Homo sapiens
tttaaagagcagcctgccctttaggtaatcaacttcggctttttaaaaccagaattgttaattatcctggcagtattgtctttgccctcaacctgataaartcactggtgaaaggatgcgattatttggtaggtgaatctaaaggatatcatttctcttttttccttcttctgctattttctctttactcacatcttcctt

SEQ ID NO: 3874 - DNA, 201 bp, Homo sapiens
gtcctaagtgataacactgcttaagcagtcaactttagtttttacagtgtaacccaacgtacgtaggacacaatcagctcatcacaggtgtgagaatgaakggtgagaaaatggaaactgaaagccaagatgtgcagttgaagaaaggaagagaaatttcagatagaaaccaaaggaagaaataggatcagtgaagacagt

SEQ ID NO: 3875 - DNA, 201 bp, Homo sapiens
tgcataaaagttttaaaaagtcactgcttcagtagtaccagagggctgtctagaaagattgcacaaaaccaatgtctaagatggatattgttggtgttcasaccttctgttatctaattataaaaaagcataacatagccacccaattgagtgcgctcataatcaaacataaccatttgaagtaaagtggaagcttaatgt

SEQ ID NO: 3876 - DNA, 201 bp, Homo sapiens
ctttcccacatcgacaccatatagtactgagttgtcctgtggaataaatgacattattataagctactactatatctttcacgatgtctcctaagtttcayggtaattcctgttgagttacttttcgggtagcagtgccactgagggcgacaataaacaaaatttcttcactgaagtgattaaaaacagcctcctttaggc

SEQ ID NO: 3877 - DNA, 201 bp, Homo sapiens
accttgtcctttggaatctcagctgtgctagcacatctttgagccagaagcctgagagtcacctttgattccttctctttctaactagcaagtcctgcctrtgccacctctaagaggcatcttacacccatctgcatttcactttaccttccagaaggtgggtactgtaagccactgccatctctttcctgcactgctaga

SEQ ID NO: 3878 - DNA, 201 bp, Homo sapiens
ttctggcacaccctgctaccctggcagcactgcctgcctttgttacctcaccatgccctctagaccacaagttatctgcaaagttgtctttcttgattcayccagctcacttctgaccttgtcctttggaatctcagctgtgctagcacatctttgagccagaagcctgagagtcacctttgattccttctctttctaact

SEQ ID NO: 3879 - DNA, 201 bp, Homo sapiens
ctggcctctggcacaggtggcccctgctgcactgggcaggcctgttgggttctgagctctgcggcctggggtgggcctgctgccctggagtggatgccttycccgggttgctgtccagctcatcactcccctgccccatggctgcacagagtcctgagcggtcggcaaatcacagtgactgttttctccccccatggacca

SEQ ID NO: 3880 - DNA, 201 bp, Homo sapiens
ccctcaaagatgtttgagctgccgtggaaaaaatccaggttatcctgctggagaaaaggatgagacaccaagtgtagagaaaggtgcaaaacatccaattyttataagcttatgtgcatcattaaattattaaacttgggccaggcattgtgggtcacaactataattccagcactttgggaggctgaggtgggagaattg

SEQ ID NO: 3881 - DNA, 201 bp, Homo sapiens
aagtctattttacatgaattagtatagccaatccagccctcttgtgtttgctgtttgcataatatatccttttccaattctttttttcagtctatttgtayctgtaactccaaattgtggctcctttagacaaggtatagttgggtcttgtttgtttttcccgtgtgacaatctctgacttttgactagattgtttaatcc

SEQ ID NO: 3882 - DNA, 201 bp, Homo sapiens
tctcacaagatctaattgtttaggtgtgtgccacctaccccctcccactctctctctcttttgctcctgcttttgctatatgaggtacctgatcctgcttyaccgtccaccatgactgtaagcttcttgaggcctccccagaagccaagcagatgccagcaccatgcttgtacagcctgcagaaccatgaaccaattaaac

SEQ ID NO: 3883 - DNA, 201 bp, Homo sapiens
gccactgcactccagattgggtgacaagagtgagactcgatctcaaaaaaaaaaaaaaaggaagtgaatgaagagcaaaaggagaccactgtgggcaactragaacacagtccaggcagagcgaacagagggcaaagcccttggtgtggtaaggaaatcactgtgtccagggagcagacacagctacatgccccggtgtgg

SEQ ID NO: 3884 - DNA, 201 bp, Homo sapiens
gagaggagaagtattcatggccattgttacaatttattcagggagctcatttcaatggggacatctcccactatcatcgctggcctgcaaagaatagtcawggcacagcctttcaagatgcccatgcttccctcaccaatgtgttacccaaagctttggtccagaaaacatcgtctgaactcctcaccccagggatcatgg

SEQ ID NO: 3885 - DNA, 201 bp, Homo sapiens
tgcacctcccccagttttatttaatgtgtttagttcctccattgcagagttatcaaccctcagtcattcttgtgccacttttgcaatttttgctttatctstctagtgcctacctgcattaccatttacttactacttatttttttaattgatttgctttgttaaatgaaagtactttaaaagaaagcatttacttcacta

SEQ ID NO: 3886 - DNA, 201 bp, Homo sapiens
gacagtcagttaaaacctagctgccgccacctgcacctcccccagttttatttaatgtgtttagttcctccattgcagagttatcaaccctcagtcattcytgtgccacttttgcaatttttgctttatctctctagtgcctacctgcattaccatttacttactacttatttttttaattgatttgctttgttaaatgaa

SEQ ID NO: 3887 - DNA, 201 bp, Homo sapiens
agaaaaatctgaagatctgcccctcccaggaggataacccttcaacagaaagctgcagggtggcgggggaaggagtcctgtgtcctcgactatactagcaygatgcagggtttcactatctcactgagctgggagcaaggggaaagagggtcttggtccaaataccacagactgagttttaggagatttgcttgaataaat

SEQ ID NO: 3888 - DNA, 201 bp, Homo sapiens
aaatgcttttttctgcatctattgagatgatcatttggttttgtccttcattctgttgatatggtgtattgcactgattgatttttaaatgttgactaacyttacattcttgaataaataccccttggttatagtgtataatttgttatatatgttgctggattgagtctgccagtattttgtgtaggagttttgcattca

SEQ ID NO: 3889 - DNA, 201 bp, Homo sapiens
tgggattatattctttttgtgactagctctttttgtggtctttctgtgactagctctttcacttagcataatgttttcaagttttatccaagtagtaacawgcgccagtattcctttctctttatgactgaataatattctagtctatggctatatcacattttatttacccatttatcagttgatggacatttgggttgt

SEQ ID NO: 3890 - DNA, 201 bp, Homo sapiens
aaagaaaatataaattctccaaatggagaagcaaaaatcccgaacctgataaataaaactaaagcaacacctggatacgtcgcagcgaaactgcagaccaycacacacagagagaactgtggcagacgctgtggcacccagagccccccaggacagagacctggtccccagtggcagcagggctggcggcctggctctcgg

SEQ ID NO: 3891 - DNA, 201 bp, Homo sapiens
tgtttttggctattcttgatcccccacaattccatatgaatcttagaaccagattttctattttaccattaaaagaattcagctgtgattctgacagagaytttgttgaatctgtacatcaatttggggaatattgtcattttaacaatattaagacttctgatccatgcatatgggatgttcttccatttatttctattt

SEQ ID NO: 3892 - DNA, 201 bp, Homo sapiens
gggattacatgtgtaagccaccacacccggcctgtagagagttttaaaatcaggacgtgtaagtcctcctactttgttcttctttttaagaattgtttttrgctattcttgatcccccacaattccatatgaatcttagaaccagattttctattttaccattaaaagaattcagctgtgattctgacagagactttgttg

SEQ ID NO: 3893 - DNA, 201 bp, Homo sapiens
agactccatctcaaccaaaaaaaaaaaaacagaagcctcctgtggccaataaccagatgaaataagctacttctcccctaaggtctcccactgtgttcctrtaactctcctaccatggcactctgctctgtgatggtgttcttgactacctcttccaccaaactgtaatttttctaatggcaaggactacctcattcagta

SEQ ID NO: 3894 - DNA, 201 bp, Homo sapiens
aatgtactaatttataaaatatattttaagaaacattttaaatatgtgttcaatggctatgagcatattattcttagtattatattccaattacttgttaytgaattggtaatttagtgaattggcttgtggaaaacttcagtaaattgcttttaggaaaattgctttagagcccatgacttttcctatttagtaaatagt

SEQ ID NO: 3895 - DNA, 201 bp, Homo sapiens
ctgtccaatatggtatctgctagccatatgcaggtatttaaatttaatctaaagttgattaaaattgtaaaaaatttaaaattcagtttttcaatcatacsagacactttgcgagtgctcaggggccacacgtggttagggtcaactgagctggacagtgcagctctgggacatatccatcattgtgggaagttcttttgg

SEQ ID NO: 3896 - DNA, 201 bp, Homo sapiens
aaactcttggccttaagtgatcctcttgcctcccaaagcactagaattacaggcatgaaacactatgtctggcctttaagagatatacttcttaagcggtrttcaggttgtcttatctcttccccttcaggagagtggtcaatgtgagctcctgggcataaagaaaagggatattttttcccctaatctgtttccaaatca

SEQ ID NO: 3897 - DNA, 201 bp, Homo sapiens
gaagaaacacggaaccaaagagagctgcctcaagagaagattctcaaagaccaggtgcccacttaactgtaaaaaagatacttgctggtggctttaaagamgacactgaagaacatcacctcagagattattttgaacagtatggggaaattgaagtgattgaaatcatgactgacagaagcagtggcaataaaaggggtt

SEQ ID NO: 3898 - DNA, 201 bp, Homo sapiens
tcgtgcggttcgacagcgacgccgcgagccagaggatggagccgcgggcgccgtggatagagcaggaggggccggagtattgggaccaggagacacggaahgtgaaggcccagtcacagactgaccgagtggacctggggaccctgcgcggctactacaaccagagcgaggccggtgagtgaccccggccgggggcgcagg

SEQ ID NO: 3899 - DNA, 201 bp, Homo sapiens
ctagagcggaataatccaaagagggtcggtcaaactcatgctatatacaagcactgaagatcagcttaatgaactactgttgaattagagttatggaaacygtgttgtcataagggaaacagagatggaagactagacctgagtgtttgtagaaacatttcagggggtaaattttaaaatcacagagaatataactgcagt

SEQ ID NO: 3900 - DNA, 201 bp, Homo sapiens
accaaaggctgggaagggtatgtatattggagggagatgaagagaagttgataaataagtacaaccatacagtaagacagaaagaataagttataatgttstatagcagagtggggtgaccatagttaataacaatgtgttgtatatttcaaatagctagaagagaggttttgaaatgttcccaccacatagaaatgataa

SEQ ID NO: 3901 - DNA, 201 bp, Homo sapiens
ctcgtctcatttgtttttctgctgtcagggatcacaattccatgcttcctgatgtccagtatctgaaaactgtggcttcatatatttttatccagtttttwttttagttgtttgaaaggtaggagaatgaatacagtccctgttaaaattctattataatcagaaatagaaatttagcaatatgtattttttaaagacaaa

SEQ ID NO: 3902 - DNA, 201 bp, Homo sapiens
atgttatcatatcttacctcttctttctattctcactgctgctgccttagatacattcctaatcctctcttggctatattgcataaatattctaatttttycctcctccaatctagttctgtctccatgttgtcctctacattattattagagcaagcttcttagttttcaacattgaagcccttcaacggccagcccttg

SEQ ID NO: 3903 - DNA, 201 bp, Homo sapiens
attgagacaccacaccccagcctaaatgtttttaatgagaatttactgagactatatttagctgtttttcatgttgacacagtacaagaaattaaacatgrtcatttggtctttatcatttactatatatgcacgcacatgtacatatatgcatgtatgaatggatgcatgtacatatataaacacttgtggtgcttcatt

SEQ ID NO: 3904 - DNA, 201 bp, Homo sapiens
agaaaacaaatggctgctctaaaactacaattgaatttaactagcagtcaataacagaaagataactggaaaatcccagaacactcggaggttaagcaacrcgcttctaagtaatacatgggtgaaagaagtctcaagagaaaattttaaattatttttaactaaatgaaaatgaaaacacaacatataaaaatttgtggg

SEQ ID NO: 3905 - DNA, 201 bp, Homo sapiens
cacatttgaacttgaagaaacatgggctttgtccttggaagggaagacaaatgtatgcaatagacctgtatttcaaatagatatttggagatgaccagagytatttctagaatgtgaaaaaggaacattattggagtagggaggggggcgttgttgagcaagattggtaaaagtaggttttagtctataggctgcctagtt

SEQ ID NO: 3906 - DNA, 201 bp, Homo sapiens
aacccaaaaatgtttaccgataatgttcagtgaaggttatatcttgtcagtaatagcagaaatcattgtgtgatgaaagctaatctgagactgagcacagyacataagagatctgggagctgaagatagcaaatgagcgaggatctgtaagaaatccaaaaaaattaaaccacaggatacagaaaaaaaaaaataaggcag

SEQ ID NO: 3907 - DNA, 201 bp, Homo sapiens
ccatgttggccaggctggtctcgaactcctgacctcaagtggcccacccaccttggcctcccaaaatgctgggattacaagtgtgagctagcacatccggyattgtcttccagaagttttatagtttcaggtcttagatttaagtccttgatccatctgaagctgatttttgtataaggtgagagatgaggatccagtttc

SEQ ID NO: 3908 - DNA, 201 bp, Homo sapiens
atgaaatttgtaggcctggcaatgtcagctgtgggcagggtgggcttgtcatcaggaccctggatggtgcatgcaggcacaggttattgcagatggagtamgtagattcccagggccctggacaacatatgcagagactgatggtagcaagtggggcaggcctatcctcgggcctccaaacggtgtgcgtggaagcccaca

SEQ ID NO: 3909 - DNA, 201 bp, Homo sapiens
ggaagacagactgaaactctttgcaaacaaagttgtaaaaggaactttcttatatgctgaaatcagttgtcttttaaaaacattatttataaacagatttytgttattccctgcaatgcatcattatagcaaatatggtcagtgccacatacacatctttcacatttagccttttaggccatgaccccccaaattccacct

SEQ ID NO: 3910 - DNA, 201 bp, Homo sapiens
aaaccatatatatatttactataagtcactgagtaattattaggaatttgcctttatgttgtaaaagagaaatcagatgttgacattatttctcttaaatrcattgtgctttcctttgcattgataaaaacgtgaagaaaaaaatagaattttaaaatttctcttaagaatggtagcaatgccatttatgtcccctgtata

SEQ ID NO: 3911 - DNA, 201 bp, Homo sapiens
gcaggaccctagaacatccaagagtatatgttctttttcttcagttaccagggtgggtagggaaggaccattaagtgggggcagggctgagtatgtctgarctcaaactctacttgggcaggccttactgtggctgctgtgggggttgggggtggtttccaggtcaatggacttatgttcctgggaggattatggctgcct

SEQ ID NO: 3912 - DNA, 201 bp, Homo sapiens; identical to SEQ ID NO: 3072

SEQ ID NO: 3913 - DNA, 201 bp, Homo sapiens
tttgaaccctgggacctgggttatttgctctaatcccagtttcataacacttgtcaggttgagtgaagactaggtccactggtataaacagtgggaactckgaggacagccaataacagtcgagtcagataaagatgcaaaatcacaggaatctaaagtagaataaagaaagtaaaacactacggaacctaaacatatttg

SEQ ID NO: 3914 - DNA, 201 bp, Homo sapiens
tttcaccaccctaaacaatcccctatgtgacacttattaaccctctccaaatctctggcaaccactgatcagattaccattaccattatcattagttgccytcccagatagtccaataaagagaatcatgtattaaatcattttcacactttgttcattgagcaatatgcattggcattcatttacatcttttcacagttt

SEQ ID NO: 3915 - DNA, 201 bp, Homo sapiens
acgaatgcaccacaaaacaggcaatactttttcaaatttctagtgtgatggtcacacagtacaagaaaacttcagacttttcacttgtaaaactaaatgcmtaatcaagtacagtataaatacttttattttgaagcaaagatgcagagtggagaattaaaaatacaaagttttgttagtttctctatctctccccttcca

SEQ ID NO: 3916 - DNA, 201 bp, Homo sapiens
ttatccgtgggtcacgccagccttctagtcaattttgatgagcgaacttggataccttggttgcaggtgaagacttcacacgcttattatgtttttttttyctatggtagactccaagcaccgctgcttttaattagccatcttggccccacccgaagttaattttttttttcttttctttagacagggtctcactctgtc

SEQ ID NO: 3917 - DNA, 201 bp, Homo sapiens
tggcagaatactgacattttggatgtaacaaattgcatttggctaaacacttaagtgaaattttaaaaactaaactatgtaagttaactttcttagtcagrtctttgtactcaactaataatggaatgactgcattcttgaaaagttcattcattcactcacactcactgagcactgacattgtgccaatcaatggtccat

SEQ ID NO: 3918 - DNA, 201 bp, Homo sapiens
tatttaatacttaggaattttccacaactttgcttctcaagaaagataaattttaatggcttcctaacattttatcatatgaatgtgctagaacgacttastcttttttattattgcatatttgttttttctcaaaaaagtacaatgcagcaagtggcgttgagaaaactgcatatccacatgcaataagaataaagttgg

SEQ ID NO: 3919 - DNA, 201 bp, Homo sapiens
cgcatggccttatcttgcattaggactacacgtcccaagacctcttgcaactctgctgctatgggacttgtactcagcttactccactgctgcaaggagtygccccattttgccaaagtggacatctgtgctatcccactccaggtggtcattacacatagacgcatccatcctgttattgggtaagttgtccatatgatg

SEQ ID NO: 3920 - DNA, 201 bp, Homo sapiens; identical to SEQ ID NO: 3330

SEQ ID NO: 3921 - DNA, 201 bp, Homo sapiens; identical to SEQ ID NO: 3331

SEQ ID NO: 3922 - DNA, 201 bp, Homo sapiens
tatttctcacgtttggagactggatgtccaagatcaaggtgttggccaatgcagtgtctgatgaaatctcttttcttgcttttagacagcgccactcctcrctacaccctgacatggcatctcctctgcttgttcgaggagggaaaggaacggggtgtgtgtgtgtgtgtgtgcgtttgtgtgtagattgctgtcttcctc

SEQ ID NO: 3923 - DNA, 201 bp, Homo sapiens
cagatatgaccttaaataggtaccctgtattttcatttctaaccagaaactcaaaacataaaagtattgattagttaaactaccatcagcaattaaccttstaagtagactgaagtgtagctgcttatattacatactttaaggagcacataaaaattctatttgccccaattattcttcagcatggcaattcttgctccc

SEQ ID NO: 3924 - DNA, 201 bp, Homo sapiens
tatctatacatatgatgtcaaaattaccaatgatttgaagataaataaacaggcttcttgtaaagaattaatgttgccagggatcccatttgtctccaaarctgtggtggtggatgccatgttgagatgttaacttattttctcctctccccttcaaggaggtatttagctctatattcaatcatttcaagaaagacatgg

SEQ ID NO: 3925 - DNA, 201 bp, Homo sapiens
ggtaagggcagatcttccttattcaagttcacttattcaaatgccaatctcttccagaaacaccctaacagatacacccagaaataatgctttctcatctrtctgggtgtctcttaactcagtcaagttcacaactaaaattaacaagccctctagaccaagcatgtcagggaagcagcagggagcaactgaacctgaaga

SEQ ID NO: 3926 - DNA, 201 bp, Homo sapiens
tgtaacttaaatacaatgatgtaacgttaacaaaacttaaatactatgatgtgaagttaatacatcttatgtttcatgacaaggagcagagaggaaagaamtcaaaatattacacacacacataaatatattcatgacaaaataaggaataaacactcctagcaattacagtcctcatttctgcagctggtcacatgctca

SEQ ID NO: 3927 - DNA, 201 bp, Homo sapiens
atctgaaatgtgtggctccaagaaagaattattatgtatggtcctctccattttcttaacctcatatgtgtttatactttcactaacttttcaagtgttarttcaaattggtctcctaagtattccctcctgttggtagcatttggctgtacagtcaaatgagcagctgcctctaagcatttgctaatgcttccttcctca

SEQ ID NO: 3928 - DNA, 201 bp, Homo sapiens
agttttacctctgtgtctatagcctccccaactagactgtaaactttgagtatgaggctatgattctttgtatgcccccactcagagctctgcatagcctrtgaaactctcctcttttcctcccattaagagatatgaaatgaatgaacagccacacattacaccatagtctggtgactatagcagagagtttagagatga

SEQ ID NO: 3929 - DNA, 201 bp, Homo sapiens
aaataagattgatgcaagcaaaatgtttattttagactctggcacatggtaagatttgttacattattccccaggtgttaaagatgaggctgaaggtaagragcagagggaaaatgcattgattaatggcatactaacaccatttgctaactttctcataatgggaaaatgttgataacatttaatatgggtccatcctta

SEQ ID NO: 3930 - DNA, 201 bp, Homo sapiens
tggaagttctggctaagacaatcagacaagagaaacaaataaagggtattcatcaaataggaaaagaggaagtcaaattgtctctgtttgaagatgacatsattctatattagaaaaccccatcgtctcagcccaaaaactccttaagctgataagcaacttcagcaaagtctcaagatacaaaaaccaatgtgcaaaaat

SEQ ID NO: 3931 - DNA, 201 bp, Homo sapiens
acagtacaagagaacaccaggtagacttctaaggtttttgactctagactcctagatgacacctgtggacccacccagggcctggaggaactcactgctcygaagaaaaggacacagacttggctggattttccacctgatgattgtagaaccccagggccttaactgaacataggcagtagccagggagtggttagagca

SEQ ID NO: 3932 - DNA, 201 bp, Homo sapiens
gtctgcggcactagtccaagaaggatggatatttcaagaaatgaagttaaaccttctaactttttcctaagcactagagattcagagtcagaatttaaaawggaatgaccaagaataaagttttattttctgacacgacagaatttgtgaatcaagagtaatacctaccataactgaataccataaaaaaggaaagaatga

SEQ ID NO: 3933 - DNA, 201 bp, Homo sapiens
tgccaaagtctctttcaggttctatattctgaaatgcaaacaactagcaatactgaataatggttagcttgctgagcaatgaggcaccccatacattgctrgtggaattttagaaaatgccgcagccgctctggaaaacagtttggcagtttcttataaagttcaatctatatctacccataaaatccaggaagtccactc

SEQ ID NO: 3934 - DNA, 201 bp, Homo sapiens
ataaaatattaatatataaatataaaaaaaggctcttacttgcaagaataggctaggctacactatagtaaataacaaaaacaacctgatacatcagtggyttcccataataaaggtttatttatcattcaccaaagtcttaaggaggtaaattggttctccagaatgatgttgcatcacatcatgacccaagaccacagg

SEQ ID NO: 3935 - DNA, 201 bp, Homo sapiens
tatccaatctaataaaatagcatataataaaaatattataatctaactgtgatatacaaaatccaacaatatatttcaataacttaagaatttctttcatraagagtaaggatatttggtattaggaaatttattaataagcttcgctacattaatatgttaaataataaaaacggcacatgcaccttaatataaatggat

SEQ ID NO: 3936 - DNA, 201 bp, Homo sapiens
gagagccaagggttccaccaagatttcccaaagcacagcagttgccattagaaacttcctaaccctccaatgttcactttacagagtgttcagagggtgakaaacagatcttttacttgatttgccatctgtgaattttaaagctgttaaggcacttttctgtctttatttccatgatgctcctgatcccatttgctagtt

SEQ ID NO: 3937 - DNA, 201 bp, Homo sapiens
gctgaagcaggaggtgggactcaactctggaggtgggcctcacacactgtaccaaattgaggactagctaaaacagggatgggggtgaaagcaccttttcrtaagacatgcccaccattgtcccgttctcctcccttaagcccttgtcttgctcatgtcagcaagcttattgccatctattcttcctagttacagacatct

SEQ ID NO: 3938 - DNA, 201 bp, Homo sapiens
ctttcttcccagctgacccagttctgcttagggtgcactgtgctcagccccaggtacctctctaggactggtctgcacctgttgcaaaatccttatgcccrtttgccagagtcttggttttccagcctctcttgcacctggcagtgggcgtgtcaactggccctggccaataaaggtagtaagagggggttgggtgcaatg

SEQ ID NO: 3939 - DNA, 201 bp, Homo sapiens
ggagacccataaagatgagacattggacttcatgttcacacacccatcaacactccagccctaaattatatttgacatttaattaaaaccccaaggcagcraagtcaagagttgaactgctacagtactggaaaaggagccgctctttaggatggattcatttacctcctgttaccaaagccatcaacactgacctccccc

SEQ ID NO: 3940 - DNA, 201 bp, Homo sapiens
tttcccttctctccttccctccttctctccttcccttcttccttcctgactgcccacatgatgcactgagcagcctccacattctagtgccatgctaaatrttacaggcacacaaagatccataaaacaactcttgcccttgtgatcttctggtggagacaaagcaatttatgaaatgcctaatatctatattagatataa

SEQ ID NO: 3941 - DNA, 201 bp, Homo sapiens
tcaagctgctcctgagggatgttagtgccccagcccttccagcctgctccactcactcaggggagtggagtaaccttccagaaaaatccctcgttcaaagscaggtgaagttcccagagcaaacttctcagtaagggtaaggtctgagggaaatgagcaggaaactgacagccccagcttccacacaggtgaacttaccag

SEQ ID NO: 3942 - DNA, 201 bp, Homo sapiens
aagcctgagcaaatgtgggtggaggctgggggagcaagagtgttggttggacacagcccagaacccctcactgtggtttgtttgaaagcttggtaagggcrtgttgcaaggagaaaggacattgacctagcaaatggggcctgctggcagacctgtgctcagcacacagagctcagctgtgtgagagtacacaggagagca

SEQ ID NO: 3943 - DNA, 201 bp, Homo sapiens
gagatggagttttgcttttgttgcccaggctggagtgcaatggtgtgatcctgggattactttctaaaattaataactgcttacagcttggttgtagcccrcaattaaaatcacattaacttcatctgaagttagtttgggaagacgtattagaatgagcattctgctggtaaggatgccgtagagcttgaaagatttgga

SEQ ID NO: 3944 - DNA, 201 bp, Homo sapiens
ctatcaacatactatctcatgttgggacttaaaaaaaaaaagaagaaaaccaaatatccgtgccatttacaaagctgctgatggtattttacagtggatcwgcaactacaaattagcagaacaaatctggtttattttttgtatctctcccctcatgacacaaagctcgttgcgtcttccattcaaagatggtggatttga

SEQ ID NO: 3945 - DNA, 201 bp, Homo sapiens
gtgtttcactagcaactgtggtttgaagatgtgcagtgacctgcccagtaccacacagatggtattaggcagaacaaggactttcgtcctcttcatacctrggctatctcctgcacagctacttgatggactaagggaaggggacttctaaattttgaggtgggagaaagagaggagaaagaaggtaccaagagtgaaccc

SEQ ID NO: 3946 - DNA, 201 bp, Homo sapiens
gtgatacactagaaaaaaatgcagcaataaacatttgtttaaatggctgatagaataaataaaactaccaaaaaaaatcctataaactcattcagaaatcycaagaagtcctggaatacagaaatgccctcctccatgactatttcacaggatgcactgcaggctatttgctcaatattgtcctgggattactttcttttt

SEQ ID NO: 3947 - DNA, 201 bp, Homo sapiens
tctcgcctgcctttttaaggcagcagcacatggtgtcccagggatgggggaggggagagccctgctcaggcgggctgtggctttcccatctccacacttaygttgactcagtttcctttactagaatgcccttcccgcacttccccttgttgcaattcattcattcatttattcattcatgcaacaagcatttatgaaaca

SEQ ID NO: 3948 - DNA, 201 bp, Homo sapiens
ataacacacgtgtattacttttgtaataataatgatgatgattttaaaatgtcccaccaacctcaatgaagtgttaggaagagaggtaatgaaatagacaygaaaagcccctaataccaggctcatagaagatcttaggccaatatcaagaaattctagacatatctttcatcttctcatcccaagaagggggttggcatg

SEQ ID NO: 3949 - DNA, 201 bp, Homo sapiens
tatcctcattttatagatgagtaaaccagggcacagagtggttaagtaaccagcccatgatcactcagctgctaagtggttgacctaggatccctggcagrgtggccctggagccttgttccggaagcatgtaccgtattgcagaggaggaaacaaactcagacagtaaggtaacaaactgaggggagccagtaaggattt

SEQ ID NO: 3950 - DNA, 201 bp, Homo sapiens
atctccccactgatcgactgtaagatgccgtattgatttattaacagctgttatttatttttggcaaggttggtgtgtgtggtggggacaaatattgattktacgtggtaccctgatttcagcaatgttagagttcagaaacaaatcacatatcttagaatcgaagggactcagtagcattttcaagtggactcagaagca

SEQ ID NO: 3951 - DNA, 201 bp, Homo sapiens
actcagtcagcgacattagccctgctccccacccaccccatgtatctcttcagatgtatgtgtcttttttctacaatgaaatcataggaaattgaaggtcrgagagtcttctttagcatatttcagtaaccctttgtggggccttgcctattgaaaaaagggctgaaaagatgttggttaacaaaacagccttccaaaaaa

SEQ ID NO: 3952 - DNA, 201 bp, Homo sapiens
tttggctccattattccctcaggcatgaaatcttcctctctagccttgtttaaatctcaacacttccctttccaaatgatttctaaggggaaacataaaargaatgttccagaatactctgttggcccaggggtgatttgccagagcagtttcctggattacggcctcttcccccatcagcaaatcatgtgaaacaaacta

SEQ ID NO: 3953 - DNA, 201 bp, Homo sapiens
tgtgatgctgaagtttggggtatgaatgatcccatcactcacctagtgagcatagtacccaataggtagttttgcaacccttgccctccttccatcctccycctactagtaatccctggtctctattgttgccatctttatgtccatgggtacccaatatttgacttctactttataagtgaaaacatttgatattttgtt

SEQ ID NO: 3954 - DNA, 201 bp, Homo sapiens
tccctgtcttgatgctatcacttgactccactggctttggctttttactgtacttccttttttttcccttcatttgtaatgcattcatccacctgcatcarcgtggctttgttctccaccacttctcagcaataactgacctcccaaaggccaagcaccccagcatggctaggtcttctcttcctgatgctcctcatggct

SEQ ID NO: 3955 - DNA, 201 bp, Homo sapiens
agcagccagcatgaacgctgtctcaaattagactgggtcagcagttgcaggcttggatgtaagcagccatataatgtcatgcaatgtcaaccctgaaatamcttgggctgactccagggagatccagggccagcaggacactgagaaagccatggaaaatctgccatcgactgttgttccttcctggtgagctggggcatg

SEQ ID NO: 3956 - DNA, 201 bp, Homo sapiens
aatgagcagattaatgagcagggtagtcccccaccagtcaggggacaataaaagctagatttaacttggcccattctttctcagataccatcgacctttgsgtgaatgtgaggtgactgttctcttccaaagtctgcctttgtgatggcaactggtttactttgtacccagactcgcctgagggagggaagccagcttatc

SEQ ID NO: 3957 - DNA, 201 bp, Homo sapiens
aaattaaggtgaaattcacattatttacaaaattagccattttaaagaaaataatccagtgacattgaacacattcacgatattgggcaaccatcacctcyctgtgtctccaaaacattttcatcaccccaaaaggaagccccattcccactaaacagttggcttgttttcgaacatcagataaatgaatcatgcaggatg

SEQ ID NO: 3958 - DNA, 201 bp, Homo sapiens
tatttacaaaattagccattttaaagaaaataatccagtgacattgaacacattcacgatattgggcaaccatcacctctctgtgtctccaaaacattttyatcaccccaaaaggaagccccattcccactaaacagttggcttgttttcgaacatcagataaatgaatcatgcaggatgtgcctttttgggtccgacttc

SEQ ID NO: 3959 - DNA, 201 bp, Homo sapiens
taaaatccagggtccctgtgtttgaggaagtttgcattctaagatatttcttcccaggctggtaccctagaatgtcatcgttccataggctgcctttgtcmtcatttatgaaatttgtcaactcttggtccagaggtctgattaggaggaaaagaagaaagtcatgtgaggccaggtgcagtggctcatgcctgtaatcct

SEQ ID NO: 3960 - DNA, 201 bp, Homo sapiens
atccatgtgtttgtgtataccagcaaatggttcctttttatttctgagtaacattccactgtatggagacatcacaatttgcttctccattcacctgctgrtggacatgtgaatgatttccagttctgggctgttttgagtaagtaaaatcaggagagtgtagcaggtgttgggcaaacaacaaacatgtctgctagtgtg

SEQ ID NO: 3961 - DNA, 201 bp, Homo sapiens
actttcagaatatagccccccacctctctctgtctctgtctctgtctctctttatgtatatgtgtgtgtgtgtatatatatatataaaactaaagctcagygccactcacaaagctgcagatgggattttacagtgccagcctagccccagatgtctttaacttccatctagactgctacggtgccttctaatggggatcc

SEQ ID NO: 3962 - DNA, 201 bp, Homo sapiens
gccttccagacatggtccagctggggtctgatgctgatttggatagatccatggcaaactggtgagtaaatatgttaaatgcctctcctggctgtgggacracagttccctccttgggccccagcctccttcctgcttctgagaccacggcctctgatctcacctctttagagctgaaggacatctaggacatgagctcag

SEQ ID NO: 3963 - DNA, 201 bp, Homo sapiens
attgtgtcctccagggctcccctgcgtgctgaggagtaatgtacctgtgtgaacagtcaggctctgctggtatgcagctgatgtcagggtggtcaggtcastctgttcctttcgcctccgtttttcttcctcatgtaaaacttccttgagctgcaggaaaagctggtgcttctcttcctgtagggccaaaagcttctcctg

SEQ ID NO: 3964 - DNA, 201 bp, Homo sapiens
atttctgctgcctgacatagtgagtgacccagccactgaatgaagcactagtctcaaagctcttgtaaaatctgccaggttacctgagagcttgtcctctstgatgaagtgtttttgtcctcttgctcagttttaggaataactgttagcttttcttttattttcaaatcactttaagataattaattttcaaaataaagt

SEQ ID NO: 3965 - DNA, 201 bp, Homo sapiens
gatctccaggtgattcatgtgcacgtttaagtttgaagagtagcactctagagaccacctgcatctctatctcctgctctagcccagcaccaacttctctwactgactgttaggggccaaggaggccatggagcattgcacctgctcttcatttgaccatccatcactcagtgggcctggcagtgcaatcctaagtgcaca

SEQ ID NO: 3966 - DNA, 201 bp, Homo sapiens
ctgtctagattctctacttggtcacatcccctttagtcttcactcctgaaatggttcttatcagggtcactgataacttccatgctaggtattctaatggscaaatctctcttttcatcatatttgaacttatagccacatttgacacaaattgtcatctttccttcttgaagcaattttcttcatgttactgcatgcctc

SEQ ID NO: 3967 - DNA, 201 bp, Homo sapiens
cttaagagagagccaaccaaggacctgagccagccaagggagtgctggcaggagggcagggcttgcccagaggttctggaagggaggggatgatagcaggyggatacatcagtgacggcaaggttccatgacatccctgggaacttgtgtcagaatgcttaggcacaaatgtcacatctcctatatttattctcccaggtc

SEQ ID NO: 3968 - DNA, 201 bp, Homo sapiens
acccacggtggggtggaagggcatggtgttgaagatataatctgatggtcacttgtggtagaattgcaggttccggctgtgttggatgaaggggagccaarggccaggttggcttgtagctgcaaagcccgactttcctgctggttgcatctgcacagagagctgtggggaagcaaggagtccaggggttggatgcagagc

SEQ ID NO: 3969 - DNA, 201 bp, Homo sapiens
gtggggagcccaagcccattacatccaaaatataaccagcaggaatccgttgccctctgagggaatctagaataatgggagctgaaagtactgaccaaacygtcagggcaatagaaatcctggatggatggagggcttggtatgagggctggagggaaactgggccgtagaaggagtcacataagcgttctagtcagaact

SEQ ID NO: 3970 - DNA, 201 bp, Homo sapiens
ccgatggtgtaaatcccaggctaagagcaagagaagaccatgtcccagttcaagcaggcaggcaggcaggaagaagttccttcttcctctacctttttgtyctttcaagctctcaacagattggattattcccacccacactggggagggcaatttactttattaaattcaactgattcaaatgctaatctcatctggaaa

SEQ ID NO: 3971 - DNA, 201 bp, Homo sapiens
ggtcatggaagtcataaggccttgtctcatttcaaggggcctaggaaataaaatcctcacgtttccagaaagagaagaaaactgggaatattggcaggtarcacgtacacctaccacaatgcctagctgagagtaagtactccataaatatttattataaatggaatgggaaagaaagacacccagttctcagatatgggt

SEQ ID NO: 3972 - DNA, 201 bp, Homo sapiens
tttgggtttaaccctcttcccacaatgtgtctctctcaaattcttgaattggaatattttcatttcagcctctctgagtttggcattgataatgcttcttsttttgtgcttagctctgtggtctgctttgatagtctcctttctaagaaactgtctgtttcctccctgtttctaagattaggcagtaaaataatacagttt

SEQ ID NO: 3973 - DNA, 201 bp, Homo sapiens
tagtaataaagagaaacccaaaattaaaagaaatttaatcttcaggcccatgcagaaaattataaagagctagtctaagaatcaccaatagacttttcaawaaagttagtatgcaaattttagagttagaaaaaaaattaaataaaccgaaacacccttgtaaagtttagaatgcatagatcatgaagtatgaacttggat

SEQ ID NO: 3974 - DNA, 201 bp, Homo sapiens
aggtacttgttcaggtggctctcgtcgtgccacacggcctcgatgccgttggcctggtcgaccatcatggcctggtggcaggccctggtgagccgctgcayctcttgcaccgaccccccgaagaacccccccaggtagtagaaatcgccctcgtccttggggatgtaggcctgggactggggccggcgctcgtaggtgaag

SEQ ID NO: 3975 - DNA, 201 bp, Homo sapiens
cggcgctcgtaggtgaaggcctcccggctgcttccgtagaagccggggtgcagggtgccgaacagcggagtcaggatctccacgcccacgtggtcgcggawctccatgtccacgtccacgcacaccaggtaatccacctcgctgaggaagcgccgctcgcagaagtcactgatcatctccatgcggcgcatggacacgtcc

SEQ ID NO: 3976 - DNA, 201 bp, Homo sapiens
gccagcaccccggccagcatggatgctccacctgctcttccctgcactcaccagaacccccgttccaggcttcctggcattagacttctggggcttaggamcccgtaactgcagaaaggaagtgtgccaagactcaggacacagaacgaagactgcctgttggtcccttcctccaaaaagtgcatggtgcggccagcagcg

SEQ ID NO: 3977 - DNA, 201 bp, Homo sapiens
acatcaaggaaaccgccctctaataccttcagaacagccccttgagctgcgttcagtttcagtgtcagtaactttactcaccacggtgtcagcacctttgrctgggggtagaccatcctgcaagcacaaagcgccgccacgtgagtttgcatggaaagcgtgggatgcaggtaagcagggggtgtgcacagccgctgaacc

SEQ ID NO: 3978 - DNA, 201 bp, Homo sapiens
gcgagcccacgagcccacgagcccacatgagctcagtaagatgctgcatgaatgacctttcccatctaccctctgggaggacaaggctggccgccaccccwctctgtcttgaacacaaggagagacctcaatgtccacagtcactcgccactgcctgggtctctaccctcggccacctcactgacttacttcttgatggca

SEQ ID NO: 3979 - DNA, 201 bp, Homo sapiens
acatggagagaggcgtgcggtcacatggagctggcagggtgccacccacatgcgcctctggcacacggccgcccccacctggaaactccactcagcttctkcctcctctgaccacccttccagaggcagccgcccttccccgggaaaccaaccagaggcaaatgcgactccaaccgggcaaatcattcccagccctccctc

SEQ ID NO: 3980 - DNA, 201 bp, Homo sapiens
aaaccaaccagaggcaaatgcgactccaaccgggcaaatcattcccagccctccctcaacattggacctgtgggaacacacagcaagctgagctttgctgrcaaagagataggaacaaaccctccccagcacccaacccccgctgcccctccccaggtaggaggtacctatcaggcctttgcaggggctttggagaacaaa

SEQ ID NO: 3981 - DNA, 201 bp, Homo sapiens
gctgaaccatgactgggcattgaccctcccgccaaggccacactcccaggctggaatcactgtggttgcttgggggctgtgtcagctcataatcccgggamctcgggaaagggccgaagctcagagtctctgattcagcacttataaactggcaagagggactaagtgacctcaggggccattgctttccacttgacttaa

SEQ ID NO: 3982 - DNA, 201 bp, Homo sapiens
ggcattgaccctcccgccaaggccacactcccaggctggaatcactgtggttgcttgggggctgtgtcagctcataatcccgggacctcgggaaagggccraagctcagagtctctgattcagcacttataaactggcaagagggactaagtgacctcaggggccattgctttccacttgacttaaggctgggagggacgt

SEQ ID NO: 3983 - DNA, 201 bp, Homo sapiens
cccaggctggaatcactgtggttgcttgggggctgtgtcagctcataatcccgggacctcgggaaagggccgaagctcagagtctctgattcagcacttayaaactggcaagagggactaagtgacctcaggggccattgctttccacttgacttaaggctgggagggacgtaaggggttgtgtctcaattcactgtgggc

SEQ ID NO: 3984 - DNA, 201 bp, Homo sapiens
ctgctgggcctccttgtgggctgctggcttccagagcccggcttcctctctgagaagtgggagagtgacacctgctccacagtggcacaaagcactgtcargtgtcacacgcagcctgtggggacgtgtgggccgcagtactgtccccacctaaaggattgtagaggctcaggagacatgagccggggccattttaactgt

SEQ ID NO: 3985 - DNA, 201 bp, Homo sapiens
agttgctattttatggggacagagcttcaggttggcaagatgaaaagagttctggagatggatggtggtgatggctgcacagcaatgtgaatggacttaamgctactgaacactccaaaatgactaagatggcaaattttatgttaagcgtatttcatcacaatttaaaaaaaatcaaaagcagtgtggccagcttggcct

SEQ ID NO: 3986 - DNA, 201 bp, Homo sapiens
gcgagactccatcacacacacacacacacaaaagccggcgacacgcagctggtcaaaactgaagctccagctccatcgtgctctctgagtggctgcaggaygagggccaagtcagggtagagactggggaaggagcggccccctccctcagagccacaggaggaaagaggacctgccccagctcccacatgcttctgtcca

SEQ ID NO: 3987 - DNA, 201 bp, Homo sapiens
gtggagtttcagaacatgtctacaaaccatgaggccccctcccatcaagagatggggtctgatattctgtgtttctaagaaataaatgcagcagaagtgaygctgggtgacttctgaagccaggcccaaaaggtgatctggcttctgtctcatctttcttgggatgttggtcttggagcctcccaaccaagctgagcagga

SEQ ID NO: 3988 - DNA, 201 bp, Homo sapiens
tggcaggtggacgagtgacaggccacgttggctggagcacagagggcgagggcagaggagggagagatgaggctggggaggtcaggaaggcaggatcagawcatggagagcctcctaccttatgttctggaaagatcactccagctactgtgagaagaagggggacagggctgatggggatggggagacaagtctgaggct

SEQ ID NO: 3989 - DNA, 201 bp, Homo sapiens
cgagggcagaggagggagagatgaggctggggaggtcaggaaggcaggatcagaacatggagagcctcctaccttatgttctggaaagatcactccagctrctgtgagaagaagggggacagggctgatggggatggggagacaagtctgaggctgtcacagagatgagggcagccccaccggagccctggagcaggacgt

SEQ ID NO: 3990 - DNA, 201 bp, Homo sapiens
acttcccctagtatctccctgctgtctcagaggctcatgttctggaaacaatcattgtctttaaggtgattttatgtatattaaagtcacgtacagtagtkcccttatccacaccttcgcttgctggagtttcagttacccatggtcaaccaaaggccaataataggtgagtacagtacagtaaaatattttgaggacagg

SEQ ID NO: 3991 - DNA, 201 bp, Homo sapiens
gaaattataggagagagacgcatcagccagaggaaagaaggcaccctagggctctgtgaatgaaacttccaccttagtttcctcccaatactcaccttgcyggtttcccaaacttggaagcctaaaaccgctctcctgggtcctgtcatttccccacacgttgattattctttgttgaagttgctccataacccagttcta

SEQ ID NO: 3992 - DNA, 201 bp, Homo sapiens
aataatacagactcaaacctggtggctatttggtttcgagctttgaattcattttgtaccccccagcgcaaccccgatactgtctatgtaaatatgagagrtcaaaggacccgtgaggggtttctcttttcctttgggttacctgcttcctgtctggttgttgaaatgccaaggtgaaagggatggccaattggatcggag

SEQ ID NO: 3993 - DNA, 201 bp, Homo sapiens
ccccacaataccactgtacatctgcttggggatggattagggctgactgactggttagctcttggaaaggtttaggcccagtacatcccatcaggtttccsaggaacgtcagattttccccttgccatgagagacatgaggtaaaattggcatcaagagctggaagtcgaatggcccttgggggctgtcccgtagggcttc

SEQ ID NO: 3994 - DNA, 201 bp, Homo sapiens
caccccagtaaggtccctcctgaccctgacaaccatggatctgattccctggcgtttcccatacacggaatcctctgatacatgctcttttatgtctggcygcatcacaccgcatgctgttttgaagattcacctatattgtcacgtgtatcaatcgttcgttctttttcatttctgagaagcacgccattgttaatccgc

SEQ ID NO: 3995 - DNA, 201 bp, Homo sapiens
taagctttgactatatgctgcctgtgagagacatacatactttagaaacaaagatacaaataggtcaaagcaaaaggatagtagatttgctatgcaaacarccgtaagggagcttgaggagaaatgctaacgtcagactaaataatttttttgtttttttgagacagagtctcactctatcacccaggttggagtgcagtg

SEQ ID NO: 3996 - DNA, 201 bp, Homo sapiens
gggtgagagcaaagggagagttgaggatggctggtggaggaggggtggggatgggggagcagagaccatgcatgggaactctgggtaagcctggagttggrgactggaggtcagaagggaggtcaaggctgactccagaggtatccaggtgacccttcaaggccacagagttgagcatgtctacactgggcagagcataga

SEQ ID NO: 3997 - DNA, 201 bp, Homo sapiens
ctggagtgtggagcagaggccaccagaaacagtcacagaacaaccatcactgtggcgatgggcctggcgtgggcccgtgtgccagaccctgtaacggccarcgttgcagtctgaggtctacgttcggggagcctcacagcccacacattcaccagacacgtcgaagccaaggccgggcagagtggagtttcagaacatgtc

SEQ ID NO: 3998 - DNA, 201 bp, Homo sapiens
gccatgctgcagaatgagaacacaggagatgaagtttagtctaggagcaggatttagggcacaagtgcatggaagccacccgagggtcccagtggaagggrcacagcgtcagcctggagtgtggagcagaggccaccagaaacagtcacagaacaaccatcactgtggcgatgggcctggcgtgggcccgtgtgccagacc

SEQ ID NO: 3999 - DNA, 201 bp, Homo sapiens
ccgccactgtcgctggcccagctgcccacagctgccgagaagtcaagtatgtgtctgcggttgcctggctagctccctctctggcctggcccagagtcccrgggccttgtgggtcagccacttcctttggtgtctggggccaactgctttgcctgccccacctacatctgacagagaagtgaccacggctctgccagcatc

SEQ ID NO: 4000 - DNA, 201 bp, Homo sapiens
gtgagcaggaaacatctggagccttgtattgagggggtggctcagcatgacggccggccacagttacagagaggagggggcagcagaagccaccatccctsggtgagacgcagcctctggagaaggagctgggttttaccgacctggcgagcccacgagcccacgagcccacatgagctcagtaagatgctgcatgaatga

SEQ ID NO: 4001 - DNA, 201 bp, Homo sapiens
agaggttgcagtgggcagagatggtgccaatgcactccagcctgggcgacagagcgagactccatcacacacacacacacacaaaagccggcgacacgcakctggtcaaaactgaagctccagctccatcgtgctctctgagtggctgcaggatgagggccaagtcagggtagagactggggaaggagcggccccctccct

SEQ ID NO: 4002 - DNA, 201 bp, Homo sapiens
gggagagcgcgccccgctgcgaagaggagttacctcccgaagggtcccagaggcttcttcctgcttttcctgatatctctcagaggagtttacactgatamcccgttcacaggaccctgatcccgtcccgccctcccggggcaccgttctcatctccgtgaaagctgggggcatctttaatgcttcctttccctcccaccc

SEQ ID NO: 4003 - DNA, 201 bp, Homo sapiens
aagaattaatattgttaaaatgtccatacaaccccaaacaatctacagattcaatgcaatccctatcaaaatttcattgacatttttcactgaaataaatraaataatcctaaaattcgtatgagggagtaacacctgctccacagtggcacaaagcactgtcaggtgccacacacagcctgttgggacatgtgggccaca

SEQ ID NO: 4004 - DNA, 201 bp, Homo sapiens
cttctgtccacacgcacacatgtgccagggctgcaggacaattctgtgacatgggaggcactgaagggaggcactgacattataccttggcaacgagacaygctgcagatggtcaggttccctaacagccatgctgcagaatgagaacacaggagatgaagtttagtctaggagcaggatttagggcacaagtgcatggaa

SEQ ID NO: 4005 - DNA, 201 bp, Homo sapiens
cagagccacaggaggaaagaggacctgccccagctcccacatgcttctgtccacacgcacacatgtgccagggctgcaggacaattctgtgacatgggagscactgaagggaggcactgacattataccttggcaacgagacatgctgcagatggtcaggttccctaacagccatgctgcagaatgagaacacaggagatg

SEQ ID NO: 4006 - DNA, 201 bp, Homo sapiens
gcctcccatgtcacagaattgtcctgcagccctggcacatgtgtgcgtgtggacagaagcatgtgggagctggggcaggtcctctttcctcctgtggctcygagggagggggccgctccttccccagtctctaccctgacttggccctcatcctgcagccactcagagagcacgatggagctggagcttcagttttgacca

SEQ ID NO: 4007 - DNA, 18 bp, Homo sapiens
acagcgtttgacacttcg

SEQ ID NO: 4008 - DNA, 19 bp, Homo sapiens
aacagcgtttgacacttca

SEQ ID NO: 4009 - DNA, 25 bp, Homo sapiens
gaaactaggagcagaggagagacta

SEQ ID NO: 4010 - DNA, 29 bp, Homo sapiens
gtccagcttaataattaacttgtcaaatt

SEQ ID NO: 4011 - DNA, 28 bp, Homo sapiens
tccagcttaataattaacttgtcaaatc

SEQ ID NO: 4012 - DNA, 22 bp, Homo sapiens
gccatgagctcattgcctacaa

SEQ ID NO: 4013 - DNA, 22 bp, Homo sapiens
aggtagatatcgtggctaagat

SEQ ID NO: 4014 - DNA, 21 bp, Homo sapiens
ggtagatatcgtggctaagac

SEQ ID NO: 4015 - DNA, 23 bp, Homo sapiens
cgtcttctcggatgtcatagtgc

SEQ ID NO: 4016 - DNA, 20 bp, Homo sapiens
gtgagttctcagatggttga

SEQ ID NO: 4017 - DNA, 19 bp, Homo sapiens
tgagttctcagatggttgg

SEQ ID NO: 4018 - DNA, 20 bp, Homo sapiens
gcttcaagctgttgacagtg

SEQ ID NO: 4019 - DNA, 22 bp, Homo sapiens
aatttttcattctgcatgtgtt

SEQ ID NO: 4020 - DNA, 22 bp, Homo sapiens
aatttttcattctgcatgtgtc

SEQ ID NO: 4021 - DNA, 22 bp, Homo sapiens
ccagggctctttcaagatagta

SEQ ID NO: 4022 - DNA, 19 bp, Homo sapiens
gatggagttttgaggaacc

SEQ ID NO: 4023 - DNA, 20 bp, Homo sapiens
cgatggagttttgaggaact

SEQ ID NO: 4024 - DNA, 17 bp, Homo sapiens
ccctgggcagaatcaga

SEQ ID NO: 4025 - DNA, 16 bp, Homo sapiens
tcccaatcccaggaca

SEQ ID NO: 4026 - DNA, 15 bp, Homo sapiens
cccaatcccaggacg

SEQ ID NO: 4027 - DNA, 23 bp, Homo sapiens
tgacattgcactctcaaatattt

SEQ ID NO: 4028 - DNA, 17 bp, Homo sapiens
agtcatggtggacggtg

SEQ ID NO: 4029 - DNA, 18 bp, Homo sapiens
cagtcatggtggacggta

SEQ ID NO: 4030 - DNA, 24 bp, Homo sapiens
cttggtgctgtcctcactgtagta

SEQ ID NO: 4031 - DNA, 17 bp, Homo sapiens
cgcggagtgtcaagagg

SEQ ID NO: 4032 - DNA, 17 bp, Homo sapiens
cgcggagtgtcaagaga

SEQ ID NO: 4033 - DNA, 20 bp, Homo sapiens
accttgggcaaaaaatacat

SEQ ID NO: 4034 - DNA, 20 bp, Homo sapiens
gttgtttgcttcatctctgc

SEQ ID NO: 4035 - DNA, 20 bp, Homo sapiens
gttgtttgcttcatctctgg

SEQ ID NO: 4036 - DNA, 18 bp, Homo sapiens
agtgctgggctcaagaac

SEQ ID NO: 4037 - DNA, 24 bp, Homo sapiens
atttctgaataactgaagttggtc

SEQ ID NO: 4038 - DNA, 24 bp, Homo sapiens
atttctgaataactgaagttggtt

SEQ ID NO: 4039 - DNA, 22 bp, Homo sapiens
ccctacctgggttatcagtaat

SEQ ID NO: 4040 - DNA, 25 bp, Homo sapiens
aatgaaatctaggaatagtgaccac

SEQ ID NO: 4041 - DNA, 26 bp, Homo sapiens
caatgaaatctaggaatagtgaccat

SEQ ID NO: 4042 - DNA, 24 bp, Homo sapiens
cttcagcccaagagtttgagacta

SEQ ID NO: 4043 - DNA, 25 bp, Homo sapiens
agagtatgtgtaattaagtcgctac

SEQ ID NO: 4044 - DNA, 26 bp, Homo sapiens
aagagtatgtgtaattaagtcgctat

SEQ ID NO: 4045 - DNA, 37 bp, Homo sapiens
actgaggatgagtaattatgtcttattaggaccatag

SEQ ID NO: 4046 - DNA, 20 bp, Homo sapiens
tgatgagtgtcgaaatggag

SEQ ID NO: 4047 - DNA, 20 bp, Homo sapiens
tgatgagtgtcgaaatggac

SEQ ID NO: 4048 - DNA, 20 bp, Homo sapiens
accggttctgctttgataac

SEQ ID NO: 4049 - DNA, 17 bp, Homo sapiens
acgcgtgtctttctcac

SEQ ID NO: 4050 - DNA, 17 bp, Homo sapiens
acgcgtgtctttctcat

SEQ ID NO: 4051 - DNA, 28 bp, Homo sapiens
aagttacttaaaatctgctttttcttag

SEQ ID NO: 4052 - DNA, 25 bp, Homo sapiens
ggctgaaattattccaataaaggac

SEQ ID NO: 4053 - DNA, 25 bp, Homo sapiens
ggctgaaattattccaataaaggaa

SEQ ID NO: 4054 - DNA, 24 bp, Homo sapiens
accaggctgttgaccttgctataa

SEQ ID NO: 4055 - DNA, 15 bp, Homo sapiens
gactgaggcccacgc

SEQ ID NO: 4056 - DNA, 15 bp, Homo sapiens
gactgaggcccacgg

SEQ ID NO: 4057 - DNA, 20 bp, Homo sapiens
gggtctgcaggttaacaaca

SEQ ID NO: 4058 - DNA, 19 bp, Homo sapiens
cccatacccaaggaacctt

SEQ ID NO: 4059 - DNA, 19 bp, Homo sapiens
cccatacccaaggaacctc

SEQ ID NO: 4060 - DNA, 20 bp, Homo sapiens
ggatcagccaagccagactt

SEQ ID NO: 4061 - DNA, 17 bp, Homo sapiens
ctggacttctgggtcct

SEQ ID NO: 4062 - DNA, 16 bp, Homo sapiens
tggacttctgggtccc

SEQ ID NO: 4063 - DNA, 21 bp, Homo sapiens
caagaagctgagcgagtgtct

SEQ ID NO: 4064 - DNA, 25 bp, Homo sapiens
taacaatttggtttatatcctccct

SEQ ID NO: 4065 - DNA, 23 bp, Homo sapiens
acaatttggtttatatcctccca

SEQ ID NO: 4066 - DNA, 27 bp, Homo sapiens
cagctctacatagtatcctggagagac

SEQ ID NO: 4067 - DNA, 19 bp, Homo sapiens
tcctccggtgtcagtttag

SEQ ID NO: 4068 - DNA, 19 bp, Homo sapiens
tcctccggtgtcagtttaa

SEQ ID NO: 4069 - DNA, 18 bp, Homo sapiens
gcagtggccagggttcat

SEQ ID NO: 4070 - DNA, 25 bp, Homo sapiens
ctttcactcactcaacacatactta

SEQ ID NO: 4071 - DNA, 23 bp, Homo sapiens
ttcactcactcaacacatacttg

SEQ ID NO: 4072 - DNA, 24 bp, Homo sapiens
gctcagttgggagatgtgtaggta

SEQ ID NO: 4073 - DNA, 22 bp, Homo sapiens
catccaacagctcttctatcat

SEQ ID NO: 4074 - DNA, 22 bp, Homo sapiens
catccaacagctcttctatcac

SEQ ID NO: 4075 - DNA, 18 bp, Homo sapiens
caaacatccgaggacaag

SEQ ID NO: 4076 - DNA, 20 bp, Homo sapiens
actctttgatggcaaccatg

SEQ ID NO: 4077 - DNA, 23 bp, Homo sapiens
ttaactctttgatggcaaccata

SEQ ID NO: 4078 - DNA, 25 bp, Homo sapiens
ggttttaagccagcactcttagact

SEQ ID NO: 4079 - DNA, 19 bp, Homo sapiens
ctgccctctttttagcaga

SEQ ID NO: 4080 - DNA, 19 bp, Homo sapiens
ctgccctctttttagcagt

SEQ ID NO: 4081 - DNA, 22 bp, Homo sapiens
ccctttctcattcattcatttt

SEQ ID NO: 4082 - DNA, 17 bp, Homo sapiens
aaggatggcctcatcag

SEQ ID NO: 4083 - DNA, 17 bp, Homo sapiens
aaggatggcctcatcaa

SEQ ID NO: 4084 - DNA, 20 bp, Homo sapiens
ccaggatggagatgaagaga

SEQ ID NO: 4085 - DNA, 25 bp, Homo sapiens
ccactgaaatgctactttgagtaac

SEQ ID NO: 4086 - DNA, 25 bp, Homo sapiens
ccactgaaatgctactttgagtaaa

SEQ ID NO: 4087 - DNA, 25 bp, Homo sapiens
agacaatctgagacatgcgaagact

SEQ ID NO: 4088 - DNA, 18 bp, Homo sapiens
ccctttcccaggcttatt

SEQ ID NO: 4089 - DNA, 18 bp, Homo sapiens
ccctttcccaggcttatc

SEQ ID NO: 4090 - DNA, 20 bp, Homo sapiens
cctcaaccaggaagtcagag

SEQ ID NO: 4091 - DNA, 18 bp, Homo sapiens
tgtgagtgggccttcact

SEQ ID NO: 4092 - DNA, 17 bp, Homo sapiens
gtgagtgggccttcaca

SEQ ID NO: 4093 - DNA, 15 bp, Homo sapiens
ggagccccgcttcat

SEQ ID NO: 4094 - DNA, 22 bp, Homo sapiens
cagttcgtgctattgagaaaat

SEQ ID NO: 4095 - DNA, 22 bp, Homo sapiens
cagttcgtgctattgagaaaac

SEQ ID NO: 4096 - DNA, 24 bp, Homo sapiens
caaagaaaaacagatcacacagat

SEQ ID NO: 4097 - DNA, 17 bp, Homo sapiens
gcacagaaagccgtgag

SEQ ID NO: 4098 - DNA, 17 bp, Homo sapiens
gcacagaaagccgtgaa

SEQ ID NO: 4099 - DNA, 21 bp, Homo sapiens
ctgtaagctcctctggttcag

SEQ ID NO: 4100 - DNA, 19 bp, Homo sapiens
acacacttcacaatggacg

SEQ ID NO: 4101 - DNA, 20 bp, Homo sapiens
cacacacttcacaatggaca

SEQ ID NO: 4102 - DNA, 26 bp, Homo sapiens
cagtaaacctggcactcttcagtagt

SEQ ID NO: 4103 - DNA, 17 bp, Homo sapiens
cgaagcttccgaggaag

SEQ ID NO: 4104 - DNA, 17 bp, Homo sapiens
cgaagcttccgaggaat

SEQ ID NO: 4105 - DNA, 19 bp, Homo sapiens
gacaccggacgagagagac

SEQ ID NO: 4106 - DNA, 23 bp, Homo sapiens
gagaaaaaagaacagatgtcctt

SEQ ID NO: 4107 - DNA, 23 bp, Homo sapiens
gagaaaaaagaacagatgtcctc

SEQ ID NO: 4108 - DNA, 22 bp, Homo sapiens
tgatgcctctcagcatttatac

SEQ ID NO: 4109 - DNA, 18 bp, Homo sapiens
gctgggaacctctatccc

SEQ ID NO: 4110 - DNA, 18 bp, Homo sapiens
gctgggaacctctatcct

SEQ ID NO: 4111 - DNA, 24 bp, Homo sapiens
gggctcatgaggaaagtttatgtg

SEQ ID NO: 4112 - DNA, 22 bp, Homo sapiens
cataatgatgttggtagggtcg

SEQ ID NO: 4113 - DNA, 22 bp, Homo sapiens
cataatgatgttggtagggtca

SEQ ID NO: 4114 - DNA, 25 bp, Homo sapiens
ccagattgattcatgctcctctcac

SEQ ID NO: 4115 - DNA, 20 bp, Homo sapiens
caatggtgggcatgtcttat

SEQ ID NO: 4116 - DNA, 19 bp, Homo sapiens
aatggtgggcatgtcttac

SEQ ID NO: 4117 - DNA, 25 bp, Homo sapiens
gagggctaaaggaaagaggtgttct

SEQ ID NO: 4118 - DNA, 17 bp, Homo sapiens
ccctttgccttgtcgtt

SEQ ID NO: 4119 - DNA, 17 bp, Homo sapiens
ccctttgccttgtcgtg

SEQ ID NO: 4120 - DNA, 23 bp, Homo sapiens
cactgcaccaggcctagaaatac

SEQ ID NO: 4121 - DNA, 25 bp, Homo sapiens
ggcagatagtagctgttcaataaac

SEQ ID NO: 4122 - DNA, 25 bp, Homo sapiens
ggcagatagtagctgttcaataaat

SEQ ID NO: 4123 - DNA, 30 bp, Homo sapiens
tttgggtagcagatcacttcattaatctga

SEQ ID NO: 4124 - DNA, 25 bp, Homo sapiens
cttgctctgataagaactttacaac

SEQ ID NO: 4125 - DNA, 26 bp, Homo sapiens
ccttgctctgataagaactttacaat

SEQ ID NO: 4126 - DNA, 19 bp, Homo sapiens
ctgccgtggcctttcaaag

SEQ ID NO: 4127 - DNA, 22 bp, Homo sapiens
tgaaaatgttcctgagctatgg

SEQ ID NO: 4128 - DNA, 22 bp, Homo sapiens
tgaaaatgttcctgagctatgc

SEQ ID NO: 4129 - DNA, 25 bp, Homo sapiens
actatcacccagaaggcgatcatac

SEQ ID NO: 4130 - DNA, 22 bp, Homo sapiens
aaagggaaggaggttacttact

SEQ ID NO: 4131 - DNA, 20 bp, Homo sapiens
agggaaggaggttacttacg

SEQ ID NO: 4132 - DNA, 20 bp, Homo sapiens
tcctctgtggagagggatac

SEQ ID NO: 4133 - DNA, 25 bp, Homo sapiens
tttgtaaacacacagagatgataat

SEQ ID NO: 4134 - DNA, 25 bp, Homo sapiens
tttgtaaacacacagagatgataac

SEQ ID NO: 4135 - DNA, 18 bp, Homo sapiens
tttccgctcgacatgtaa

SEQ ID NO: 4136 - DNA, 24 bp, Homo sapiens
ttcttttaaaggattggtaaactc

SEQ ID NO: 4137 - DNA, 24 bp, Homo sapiens
ttcttttaaaggattggtaaactg

SEQ ID NO: 4138 - DNA, 22 bp, Homo sapiens
agagcagaacgaggttttattt

SEQ ID NO: 4139 - DNA, 14 bp, Homo sapiens
ggacccccgaaggc

SEQ ID NO: 4140 - DNA, 15 bp, Homo sapiens
tggacccccgaagga

SEQ ID NO: 4141 - DNA, 18 bp, Homo sapiens
ggccccaacagttgactg

SEQ ID NO: 4142 - DNA, 17 bp, Homo sapiens
agtggcctcatcctcct

SEQ ID NO: 4143 - DNA, 16 bp, Homo sapiens
gtggcctcatcctcca

SEQ ID NO: 4144 - DNA, 20 bp, Homo sapiens
gaacgcttacgagccttatc

SEQ ID NO: 4145 - DNA, 24 bp, Homo sapiens
ggggctatgtagactacatcttta

SEQ ID NO: 4146 - DNA, 23 bp, Homo sapiens
gggctatgtagactacatctttg

SEQ ID NO: 4147 - DNA, 24 bp, Homo sapiens
ttcaacaatgcgttggcaagagat

SEQ ID NO: 4148 - DNA, 22 bp, Homo sapiens
tgatgctaatctgttctctgtg

SEQ ID NO: 4149 - DNA, 24 bp, Homo sapiens
tctgatgctaatctgttctctgta

SEQ ID NO: 4150 - DNA, 23 bp, Homo sapiens
ataacaagaggaaggagatcaga

SEQ ID NO: 4151 - DNA, 21 bp, Homo sapiens
tcgtgtctaccttagggtaca

SEQ ID NO: 4152 - DNA, 20 bp, Homo sapiens
cgtgtctaccttagggtacg

SEQ ID NO: 4153 - DNA, 19 bp, Homo sapiens
cgtatggcttcaggatgtc

SEQ ID NO: 4154 - DNA, 28 bp, Homo sapiens
gaagatgttactcctaatatcatacagt

SEQ ID NO: 4155 - DNA, 27 bp, Homo sapiens
aagatgttactcctaatatcatacagg

SEQ ID NO: 4156 - DNA, 26 bp, Homo sapiens
gttgtaccctcattgtgacattaggt

SEQ ID NO: 4157 - DNA, 24 bp, Homo sapiens
ttattcctagttccaatgaaagat

SEQ ID NO: 4158 - DNA, 24 bp, Homo sapiens
ttattcctagttccaatgaaagac

SEQ ID NO: 4159 - DNA, 21 bp, Homo sapiens
gcctcttgggagtactcactt

SEQ ID NO: 4160 - DNA, 15 bp, Homo sapiens
tcgcaggtgtcccta

SEQ ID NO: 4161 - DNA, 14 bp, Homo sapiens
cgcaggtgtccctg

SEQ ID NO: 4162 - DNA, 15 bp, Homo sapiens
ccccatcccttctca

SEQ ID NO: 4163 - DNA, 25 bp, Homo sapiens
gaagtgaaataatggttcagcatac

SEQ ID NO: 4164 - DNA, 25 bp, Homo sapiens
gaagtgaaataatggttcagcatat

SEQ ID NO: 4165 - DNA, 30 bp, Homo sapiens
ctgcatctgttgagattattgtatgacgtt

SEQ ID NO: 4166 - DNA, 30 bp, Homo sapiens
gtgttatactgtatcactcttcttttctaa

SEQ ID NO: 4167 - DNA, 29 bp, Homo sapiens
tgttatactgtatcactcttcttttctag

SEQ ID NO: 4168 - DNA, 18 bp, Homo sapiens
gggggcggaacttagaca

SEQ ID NO: 4169 - DNA, 23 bp, Homo sapiens
cagttttccatgggttctactac

SEQ ID NO: 4170 - DNA, 23 bp, Homo sapiens
cagttttccatgggttctactat

SEQ ID NO: 4171 - DNA, 25 bp, Homo sapiens
ttatgaaatggtacagacaagtgat

SEQ ID NO: 4172 - DNA, 23 bp, Homo sapiens
ccagttttggtgtcaactagaaa

SEQ ID NO: 4173 - DNA, 23 bp, Homo sapiens
ccagttttggtgtcaactagaag

SEQ ID NO: 4174 - DNA, 23 bp, Homo sapiens
ttgcaacctgaaaaacataacta

SEQ ID NO: 4175 - DNA, 16 bp, Homo sapiens
ggagccaggcctacat

SEQ ID NO: 4176 - DNA, 16 bp, Homo sapiens
ggagccaggcctacac

SEQ ID NO: 4177 - DNA, 17 bp, Homo sapiens
cgcctcgacgagattct

SEQ ID NO: 4178 - DNA, 17 bp, Homo sapiens
ccttcggagttgcacag

SEQ ID NO: 4179 - DNA, 17 bp, Homo sapiens
ccttcggagttgcacaa

SEQ ID NO: 4180 - DNA, 21 bp, Homo sapiens
tttttggtgggtttctctgta

SEQ ID NO: 4181 - DNA, 15 bp, Homo sapiens
ccctgggggtctttc

SEQ ID NO: 4182 - DNA, 15 bp, Homo sapiens
ccctgggggtctttg

SEQ ID NO: 4183 - DNA, 17 bp, Homo sapiens
ccgtggcctctgtgatt

SEQ ID NO: 4184 - DNA, 23 bp, Homo sapiens
acacacatatggtggttcataat

SEQ ID NO: 4185 - DNA, 22 bp, Homo sapiens
cacacatatggtggttcataac

SEQ ID NO: 4186 - DNA, 19 bp, Homo sapiens
catgtcccagctcttcttg

SEQ ID NO: 4187 - DNA, 24 bp, Homo sapiens
tatgcaaggtgttgttatagattt

SEQ ID NO: 4188 - DNA, 25 bp, Homo sapiens
gtatgcaaggtgttgttatagatta

SEQ ID NO: 4189 - DNA, 24 bp, Homo sapiens
gcgttgtaactgagttcattattc

SEQ ID NO: 4190 - DNA, 25 bp, Homo sapiens
ttcaagctatttgtagttcctagag

SEQ ID NO: 4191 - DNA, 26 bp, Homo sapiens
cttcaagctatttgtagttcctagaa

SEQ ID NO: 4192 - DNA, 23 bp, Homo sapiens
ggtgtggccttctttggaagatc

SEQ ID NO: 4193 - DNA, 22 bp, Homo sapiens
ggttaaatgacactctttgggg

SEQ ID NO: 4194 - DNA, 22 bp, Homo sapiens
ggttaaatgacactctttggga

SEQ ID NO: 4195 - DNA, 27 bp, Homo sapiens
gtttcagaaagatttgtcaggaccact

SEQ ID NO: 4196 - DNA, 24 bp, Homo sapiens
tgtttctcccacatattcacatac

SEQ ID NO: 4197 - DNA, 25 bp, Homo sapiens
ctgtttctcccacatattcacatat

SEQ ID NO: 4198 - DNA, 24 bp, Homo sapiens
cgctacatcactcagctcatgaaa

SEQ ID NO: 4199 - DNA, 18 bp, Homo sapiens
caactcacacgggaagac

SEQ ID NO: 4200 - DNA, 18 bp, Homo sapiens
caactcacacgggaagat

SEQ ID NO: 4201 - DNA, 27 bp, Homo sapiens
gtgaatatgtgggagaaacagcactag

SEQ ID NO: 4202 - DNA, 21 bp, Homo sapiens
atttcctccctcacatgatac

SEQ ID NO: 4203 - DNA, 21 bp, Homo sapiens
atttcctccctcacatgatat

SEQ ID NO: 4204 - DNA, 23 bp, Homo sapiens
tcaaagaatgaagagtgaagaca

SEQ ID NO: 4205 - DNA, 19 bp, Homo sapiens
tcaacagaatgccatgagc

SEQ ID NO: 4206 - DNA, 20 bp, Homo sapiens
gtcaacagaatgccatgaga

SEQ ID NO: 4207 - DNA, 25 bp, Homo sapiens
caaggcagaagtagttgtccaacag

SEQ ID NO: 4208 - DNA, 18 bp, Homo sapiens
gaggcgaaaggaacagag

SEQ ID NO: 4209 - DNA, 18 bp, Homo sapiens
gaggcgaaaggaacagac

SEQ ID NO: 4210 - DNA, 21 bp, Homo sapiens
gcgtgctgaggagtaatgtac

SEQ ID NO: 4211 - DNA, 27 bp, Homo sapiens
ggtccaaatagactaactttaagtgac

SEQ ID NO: 4212 - DNA, 27 bp, Homo sapiens
ggtccaaatagactaactttaagtgat

SEQ ID NO: 4213 - DNA, 27 bp, Homo sapiens
cccacacaacatacaatttacaaatgc

SEQ ID NO: 4214 - DNA, 17 bp, Homo sapiens
cagattcagcctcccaa

SEQ ID NO: 4215 - DNA, 17 bp, Homo sapiens
cagattcagcctcccag

SEQ ID NO: 4216 - DNA, 21 bp, Homo sapiens
gcagttggaaatctgaatttc

SEQ ID NO: 4217 - DNA, 17 bp, Homo sapiens
gggatggaagagcttca

SEQ ID NO: 4218 - DNA, 17 bp, Homo sapiens
gggatggaagagcttcg

SEQ ID NO: 4219 - DNA, 18 bp, Homo sapiens
ctgcagccttcctctgac

SEQ ID NO: 4220 - DNA, 18 bp, Homo sapiens
gaaacggctggtttgtgt

SEQ ID NO: 4221 - DNA, 16 bp, Homo sapiens
aacggctggtttgtgc

SEQ ID NO: 4222 - DNA, 24 bp, Homo sapiens
tccaatctaccttttccttgtatt

SEQ ID NO: 4223 - DNA, 14 bp, Homo sapiens
gcctcccctgctgc

SEQ ID NO: 4224 - DNA, 15 bp, Homo sapiens
ggcctcccctgctgg

SEQ ID NO: 4225 - DNA, 20 bp, Homo sapiens
aggtcccttctgctgtaatg

SEQ ID NO: 4226 - DNA, 14 bp, Homo sapiens
acgctgctgttccg

SEQ ID NO: 4227 - DNA, 15 bp, Homo sapiens
cacgctgctgttcca

SEQ ID NO: 4228 - DNA, 24 bp, Homo sapiens
cagacagacaacaattcagaagaa

SEQ ID NO: 4229 - DNA, 17 bp, Homo sapiens
gtcacacacccaggagc

SEQ ID NO: 4230 - DNA, 18 bp, Homo sapiens
ggtcacacacccaggagt

SEQ ID NO: 4231 - DNA, 21 bp, Homo sapiens
ggatgattgccataatgagtc

SEQ ID NO: 4232 - DNA, 21 bp, Homo sapiens
tgtccagatccacatagaaca

SEQ ID NO: 4233 - DNA, 22 bp, Homo sapiens
ttgtccagatccacatagaact

SEQ ID NO: 4234 - DNA, 18 bp, Homo sapiens
ctttatgcagcggaccat

SEQ ID NO: 4235 - DNA, 17 bp, Homo sapiens
acggcatcttctatccg

SEQ ID NO: 4236 - DNA, 18 bp, Homo sapiens
cacggcatcttctatcca

SEQ ID NO: 4237 - DNA, 17 bp, Homo sapiens
ccagctggtggtgagtg

SEQ ID NO: 4238 - DNA, 15 bp, Homo sapiens
gatggcatggatggc

SEQ ID NO: 4239 - DNA, 16 bp, Homo sapiens
ggatggcatggatggt

SEQ ID NO: 4240 - DNA, 20 bp, Homo sapiens
gcaggatgtgctgtgattat

SEQ ID NO: 4241 - DNA, 20 bp, Homo sapiens
caacctgacatggaagaaat

SEQ ID NO: 4242 - DNA, 20 bp, Homo sapiens
caacctgacatggaagaaac

SEQ ID NO: 4243 - DNA, 20 bp, Homo sapiens
gatgtggtgggatttgacat

SEQ ID NO: 4244 - DNA, 18 bp, Homo sapiens
gagagagaacagccagac

SEQ ID NO: 4245 - DNA, 18 bp, Homo sapiens
gagagagaacagccagat

SEQ ID NO: 4246 - DNA, 18 bp, Homo sapiens
gcatcccaggtcaaggta

SEQ ID NO: 4247 - DNA, 21 bp, Homo sapiens
cccaaattctgcatagcataa

SEQ ID NO: 4248 - DNA, 21 bp, Homo sapiens
cccaaattctgcatagcatag

SEQ ID NO: 4249 - DNA, 17 bp, Homo sapiens
gtgggctcgggtctcta

SEQ ID NO: 4250 - DNA, 17 bp, Homo sapiens
tggaaagcctcaagtct

SEQ ID NO: 4251 - DNA, 16 bp, Homo sapiens
ggaaagcctcaagtcc

SEQ ID NO: 4252 - DNA, 25 bp, Homo sapiens
ttctagaggtggtcagctaatactt

SEQ ID NO: 4253 - DNA, 22 bp, Homo sapiens
accatcagttaccttcatgact

SEQ ID NO: 4254 - DNA, 20 bp, Homo sapiens
catcagttaccttcatgacg

SEQ ID NO: 4255 - DNA, 18 bp, Homo sapiens
gcggaccacctgttaatc

SEQ ID NO: 4256 - DNA, 17 bp, Homo sapiens
catggagatccaagtcg

SEQ ID NO: 4257 - DNA, 18 bp, Homo sapiens
acatggagatccaagtca

SEQ ID NO: 4258 - DNA, 18 bp, Homo sapiens
gactcaggcaggacaacc

SEQ ID NO: 4259 - DNA, 22 bp, Homo sapiens
ctcccctactctgctcatatat

SEQ ID NO: 4260 - DNA, 22 bp, Homo sapiens
ctcccctactctgctcatatac

SEQ ID NO: 4261 - DNA, 23 bp, Homo sapiens
cattctccccaccaggcatttat

SEQ ID NO: 4262 - DNA, 19 bp, Homo sapiens
actgagagcttgtcctcag

SEQ ID NO: 4263 - DNA, 19 bp, Homo sapiens
actgagagcttgtcctcaa

SEQ ID NO: 4264 - DNA, 19 bp, Homo sapiens
cacacccagagaccacagg

SEQ ID NO: 4265 - DNA, 17 bp, Homo sapiens
tgtcggtaaacatggca

SEQ ID NO: 4266 - DNA, 16 bp, Homo sapiens
gtcggtaaacatggcg

SEQ ID NO: 4267 - DNA, 19 bp, Homo sapiens
ggtgggtggtctgactctc

SEQ ID NO: 4268 - DNA, 24 bp, Homo sapiens
ctgatggtattttacagtggatca

SEQ ID NO: 4269 - DNA, 24 bp, Homo sapiens
ctgatggtattttacagtggatct

SEQ ID NO: 4270 - DNA, 21 bp, Homo sapiens
aagacgcaacgagctttgtgt

SEQ ID NO: 4271 - DNA, 16 bp, Homo sapiens
tgcattactcggaccc

SEQ ID NO: 4272 - DNA, 17 bp, Homo sapiens
ctgcattactcggacct

SEQ ID NO: 4273 - DNA, 15 bp, Homo sapiens
tgcccgcaccttgtc

SEQ ID NO: 4274 - DNA, 19 bp, Homo sapiens
gttgctcatagttgctggc

SEQ ID NO: 4275 - DNA, 19 bp, Homo sapiens
gttgctcatagttgctggg

SEQ ID NO: 4276 - DNA, 20 bp, Homo sapiens
cagcatcttcgacagagaca

SEQ ID NO: 4277 - DNA, 17 bp, Homo sapiens
tactgtcccgtgttcca

SEQ ID NO: 4278 - DNA, 15 bp, Homo sapiens
ctgtcccgtgttccg

SEQ ID NO: 4279 - DNA, 19 bp, Homo sapiens
ctctcccagagccctctag

SEQ ID NO: 4280 - DNA, 18 bp, Homo sapiens
gctgcgtttctactctgc

SEQ ID NO: 4281 - DNA, 19 bp, Homo sapiens
tgctgcgtttctactctga

SEQ ID NO: 4282 - DNA, 23 bp, Homo sapiens
actcatgcgcatgcacataaaca

SEQ ID NO: 4283 - DNA, 16 bp, Homo sapiens
cgccctgcactttcac

SEQ ID NO: 4284 - DNA, 16 bp, Homo sapiens
cgccctgcactttcag

SEQ ID NO: 4285 - DNA, 21 bp, Homo sapiens
ccgtgctctactgcttctcta

SEQ ID NO: 4286 - DNA, 20 bp, Homo sapiens
tggagggtccaactcataac

SEQ ID NO: 4287 - DNA, 20 bp, Homo sapiens
tggagggtccaactcataat

SEQ ID NO: 4288 - DNA, 25 bp, Homo sapiens
gggattgctcagcatctccttaaat

SEQ ID NO: 4289 - DNA, 21 bp, Homo sapiens
tcactgatgtcaatgaacact

SEQ ID NO: 4290 - DNA, 19 bp, Homo sapiens
actgatgtcaatgaacacc

SEQ ID NO: 4291 - DNA, 20 bp, Homo sapiens
cccatcccagagttcttgtc

SEQ ID NO: 4292 - DNA, 19 bp, Homo sapiens
atttccctgggaagacttc

SEQ ID NO: 4293 - DNA, 19 bp, Homo sapiens
atttccctgggaagacttt

SEQ ID NO: 4294 - DNA, 22 bp, Homo sapiens
ctagtggtggaaggaaatgtta

SEQ ID NO: 4295 - DNA, 14 bp, Homo sapiens
cggcctgcgtggac

SEQ ID NO: 4296 - DNA, 14 bp, Homo sapiens
cggcctgcgtggat

SEQ ID NO: 4297 - DNA, 16 bp, Homo sapiens
gcccagggcgtgttct

SEQ ID NO: 4298 - DNA, 16 bp, Homo sapiens
tccgggtgcacgtata

SEQ ID NO: 4299 - DNA, 14 bp, Homo sapiens
cgggtgcacgtatg

SEQ ID NO: 4300 - DNA, 22 bp, Homo sapiens
tggagagtgtttgctcatctac

SEQ ID NO: 4301 - DNA, 22 bp, Homo sapiens
tgttttcatccacttgaactgt

SEQ ID NO: 4302 - DNA, 20 bp, Homo sapiens
ttttcatccacttgaactgc

SEQ ID NO: 4303 - DNA, 21 bp, Homo sapiens
caattttggctcccttaaaag

SEQ ID NO: 4304 - DNA, 23 bp, Homo sapiens
ctcctgactgtgaacaacttatc

SEQ ID NO: 4305 - DNA, 23 bp, Homo sapiens
ctcctgactgtgaacaacttatt

SEQ ID NO: 4306 - DNA, 19 bp, Homo sapiens
cccccagttgtgcatacac

SEQ ID NO: 4307 - DNA, 20 bp, Homo sapiens
agctgaaaggagaagtcagt

SEQ ID NO: 4308 - DNA, 20 bp, Homo sapiens
agctgaaaggagaagtcaga

SEQ ID NO: 4309 - DNA, 24 bp, Homo sapiens
ccctgctacgaaggtggaatatct

SEQ ID NO: 4310 - DNA, 14 bp, Homo sapiens
ctgcggctccacct

SEQ ID NO: 4311 - DNA, 13 bp, Homo sapiens
tgcggctccacca

SEQ ID NO: 4312 - DNA, 18 bp, Homo sapiens
tggcatctgccatactca

SEQ ID NO: 4313 - DNA, 24 bp, Homo sapiens
cacagacttgatgtttttgaaagt

SEQ ID NO: 4314 - DNA, 22 bp, Homo sapiens
cagacttgatgtttttgaaagc

SEQ ID NO: 4315 - DNA, 19 bp, Homo sapiens
tgcaaaggaagcaacttca

SEQ ID NO: 4316 - DNA, 14 bp, Homo sapiens
gggtccggccacac

SEQ ID NO: 4317 - DNA, 14 bp, Homo sapiens
gggtccggccacat

SEQ ID NO: 4318 - DNA, 16 bp, Homo sapiens
gggcccctcagtgaag

SEQ ID NO: 4319 - DNA, 20 bp, Homo sapiens
ctgctctcagaacctcagtc

SEQ ID NO: 4320 - DNA, 20 bp, Homo sapiens
ctgctctcagaacctcagtt

SEQ ID NO: 4321 - DNA, 21 bp, Homo sapiens
cactgcagggaaatagagaaa

SEQ ID NO: 4322 - DNA, 21 bp, Homo sapiens
caggttcactgtttctccaat

SEQ ID NO: 4323 - DNA, 21 bp, Homo sapiens
caggttcactgtttctccaac

SEQ ID NO: 4324 - DNA, 21 bp, Homo sapiens
gagcacatccttccattgtaa

SEQ ID NO: 4325 - DNA, 21 bp, Homo sapiens
tgttcttccttatgatgatgt

SEQ ID NO: 4326 - DNA, 20 bp, Homo sapiens
gttcttccttatgatgatgc

SEQ ID NO: 4327 - DNA, 21 bp, Homo sapiens
ggcgttcctctcaccttaata

SEQ ID NO: 4328 - DNA, 14 bp, Homo sapiens
ggcacccccgacag

SEQ ID NO: 4329 - DNA, 14 bp, Homo sapiens
ggcacccccgacaa

SEQ ID NO: 4330 - DNA, 23 bp, Homo sapiens
tccttatgctctcagtgaagttc

SEQ ID NO: 4331 - DNA, 21 bp, Homo sapiens
gccatcatttgcttctaacac

SEQ ID NO: 4332 - DNA, 21 bp, Homo sapiens
gccatcatttgcttctaacat

SEQ ID NO: 4333 - DNA, 22 bp, Homo sapiens
gcttatttgccagaaaacattt

SEQ ID NO: 4334 - DNA, 23 bp, Homo sapiens
gagcaccttaactatagatggtg

SEQ ID NO: 4335 - DNA, 24 bp, Homo sapiens
tgagcaccttaactatagatggta

SEQ ID NO: 4336 - DNA, 22 bp, Homo sapiens
cttgtcaaggcacagaataatt

SEQ ID NO: 4337 - DNA, 18 bp, Homo sapiens
attagccccaaagcgtac

SEQ ID NO: 4338 - DNA, 18 bp, Homo sapiens
attagccccaaagcgtag

SEQ ID NO: 4339 - DNA, 24 bp, Homo sapiens
gctttagaaggctggatatttatg

SEQ ID NO: 4340 - DNA, 17 bp, Homo sapiens
agtggagcttcagggct

SEQ ID NO: 4341 - DNA, 15 bp, Homo sapiens
tggagcttcagggcg

SEQ ID NO: 4342 - DNA, 23 bp, Homo sapiens
cagtggagacagaggatgtttac

SEQ ID NO: 4343 - DNA, 21 bp, Homo sapiens
ccagagtccacagaaagtttc

SEQ ID NO: 4344 - DNA, 21 bp, Homo sapiens
ccagagtccacagaaagtttt

SEQ ID NO: 4345 - DNA, 21 bp, Homo sapiens
gaaaataacgcaagcagtttc

SEQ ID NO: 4346 - DNA, 18 bp, Homo sapiens
ctggctgggtcactaacc

SEQ ID NO: 4347 - DNA, 19 bp, Homo sapiens
gctggctgggtcactaact

SEQ ID NO: 4348 - DNA, 20 bp, Homo sapiens
cctcacctgcattcacattt

SEQ ID NO: 4349 - DNA, 26 bp, Homo sapiens
tgttctcaatgaatcaaagctattac

SEQ ID NO: 4350 - DNA, 28 bp, Homo sapiens
catgttctcaatgaatcaaagctattat

SEQ ID NO: 4351 - DNA, 25 bp, Homo sapiens
gtcttccccatgttcatactcttgt

SEQ ID NO: 4352 - DNA, 21 bp, Homo sapiens
ggctttacagaaggaaatgct

SEQ ID NO: 4353 - DNA, 20 bp, Homo sapiens
gctttacagaaggaaatgcc

SEQ ID NO: 4354 - DNA, 22 bp, Homo sapiens
gcatgcgctgaattttatatag

SEQ ID NO: 4355 - DNA, 25 bp, Homo sapiens
ggaaattgttgagtgtttgtaaagt

SEQ ID NO: 4356 - DNA, 25 bp, Homo sapiens
ggaaattgttgagtgtttgtaaagc

SEQ ID NO: 4357 - DNA, 24 bp, Homo sapiens
caatgcccaaagttggctatgatt

SEQ ID NO: 4358 - DNA, 19 bp, Homo sapiens
cctcagaatggccaaaaac

SEQ ID NO: 4359 - DNA, 19 bp, Homo sapiens
cctcagaatggccaaaaat

SEQ ID NO: 4360 - DNA, 18 bp, Homo sapiens
ccaggcagccagacttct

SEQ ID NO: 4361 - DNA, 20 bp, Homo sapiens
gcacctctgggtgaagaata

SEQ ID NO: 4362 - DNA, 19 bp, Homo sapiens
cacctctgggtgaagaatg

SEQ ID NO: 4363 - DNA, 19 bp, Homo sapiens
ggcacaggcaagtctgatt

SEQ ID NO: 4364 - DNA, 18 bp, Homo sapiens
ccactgctgcaaggagtc

SEQ ID NO: 4365 - DNA, 18 bp, Homo sapiens
ccactgctgcaaggagtt

SEQ ID NO: 4366 - DNA, 24 bp, Homo sapiens
gcagtcatcatatggacaacttac

SEQ ID NO: 4367 - DNA, 21 bp, Homo sapiens
gagagtcgcagggtattttaa

SEQ ID NO: 4368 - DNA, 21 bp, Homo sapiens
gagagtcgcagggtattttag

SEQ ID NO: 4369 - DNA, 18 bp, Homo sapiens
aaaggcccaggctctaga

SEQ ID NO: 4370 - DNA, 21 bp, Homo sapiens
ctccttaagaagaatgccacc

SEQ ID NO: 4371 - DNA, 22 bp, Homo sapiens
tctccttaagaagaatgccact

SEQ ID NO: 4372 - DNA, 28 bp, Homo sapiens
agccagtttagcatttactctttacaag

SEQ ID NO: 4373 - DNA, 17 bp, Homo sapiens
ccccgaagcctatggct

SEQ ID NO: 4374 - DNA, 16 bp, Homo sapiens
cccgaagcctatggcg

SEQ ID NO: 4375 - DNA, 18 bp, Homo sapiens
cgtcagcacccaactctg

SEQ ID NO: 4376 - DNA, 24 bp, Homo sapiens
ccctaaatgcagaaattgaatctt

SEQ ID NO: 4377 - DNA, 24 bp, Homo sapiens
ccctaaatgcagaaattgaatctc

SEQ ID NO: 4378 - DNA, 23 bp, Homo sapiens
ccctctgaaatgctgctgtaact

SEQ ID NO: 4379 - DNA, 27 bp, Homo sapiens
gcagtttgagtataaattgtttgacta

SEQ ID NO: 4380 - DNA, 27 bp, Homo sapiens
gcagtttgagtataaattgtttgactc

SEQ ID NO: 4381 - DNA, 24 bp, Homo sapiens
cagtgacagatgagtgcagagaat

SEQ ID NO: 4382 - DNA, 15 bp, Homo sapiens
ggagccccaggaaag

SEQ ID NO: 4383 - DNA, 15 bp, Homo sapiens
ggagccccaggaaac

SEQ ID NO: 4384 - DNA, 17 bp, Homo sapiens
agagccctcggttcttg

SEQ ID NO: 4385 - DNA, 15 bp, Homo sapiens
cacggcggtcatgtg

SEQ ID NO: 4386 - DNA, 16 bp, Homo sapiens
ccacggcggtcatgta

SEQ ID NO: 4387 - DNA, 19 bp, Homo sapiens
ggtggagcttggtttctca

SEQ ID NO: 4388 - DNA, 22 bp, Homo sapiens
tgtagatcatgtggatggattg

SEQ ID NO: 4389 - DNA, 24 bp, Homo sapiens
aatgtagatcatgtggatggattc

SEQ ID NO: 4390 - DNA, 26 bp, Homo sapiens
ctgtcaggctgtctgtaagtctctat

SEQ ID NO: 4391 - DNA, 17 bp, Homo sapiens
ttctggggcatacaacg

SEQ ID NO: 4392 - DNA, 18 bp, Homo sapiens
cttctggggcatacaaca

SEQ ID NO: 4393 - DNA, 19 bp, Homo sapiens
agggacaaccctccataaa

SEQ ID NO: 4394 - DNA, 18 bp, Homo sapiens
cctcagagtatgtgccca

SEQ ID NO: 4395 - DNA, 18 bp, Homo sapiens
cctcagagtatgtgcccg

SEQ ID NO: 4396 - DNA, 18 bp, Homo sapiens
gcccggctgcatctagtt

SEQ ID NO: 4397 - DNA, 17 bp, Homo sapiens
tctctgagctgagtgcc

SEQ ID NO: 4398 - DNA, 18 bp, Homo sapiens
gtctctgagctgagtgct

SEQ ID NO: 4399 - DNA, 24 bp, Homo sapiens
tccctatcctaactctccttgtct

SEQ ID NO: 4400 - DNA, 19 bp, Homo sapiens
gtcagtagcgctcactttt

SEQ ID NO: 4401 - DNA, 19 bp, Homo sapiens
gtcagtagcgctcacttta

SEQ ID NO: 4402 - DNA, 25 bp, Homo sapiens
ggctacttagctgcagttcaaactc

SEQ ID NO: 4403 - DNA, 24 bp, Homo sapiens
ccacttaataacaacactacttgc

SEQ ID NO: 4404 - DNA, 25 bp, Homo sapiens
gccacttaataacaacactacttga

SEQ ID NO: 4405 - DNA, 26 bp, Homo sapiens
gactgagcctgtttcctcacctataa

SEQ ID NO: 4406 - DNA, 20 bp, Homo sapiens
tgtcgaatgggagtcttctt

SEQ ID NO: 4407 - DNA, 20 bp, Homo sapiens
tgtcgaatgggagtcttctc

SEQ ID NO: 4408 - DNA, 25 bp, Homo sapiens
cctagtagtacaacggaagaaacag

SEQ ID NO: 4409 - DNA, 21 bp, Homo sapiens
cctcctagagaagatctgcac

SEQ ID NO: 4410 - DNA, 21 bp, Homo sapiens
cctcctagagaagatctgcat

SEQ ID NO: 4411 - DNA, 18 bp, Homo sapiens
aaggcccctcttctgtct

SEQ ID NO: 4412 - DNA, 19 bp, Homo sapiens
ttcctaacagaggcttgga

SEQ ID NO: 4413 - DNA, 18 bp, Homo sapiens
tcctaacagaggcttggc

SEQ ID NO: 4414 - DNA, 19 bp, Homo sapiens
tgcagtgtcccctagaatg

SEQ ID NO: 4415 - DNA, 23 bp, Homo sapiens
cctaccttgaattcacctatctg

SEQ ID NO: 4416 - DNA, 23 bp, Homo sapiens
cctaccttgaattcacctatcta

SEQ ID NO: 4417 - DNA, 22 bp, Homo sapiens
catttccaaatcagaaacatga

SEQ ID NO: 4418 - DNA, 17 bp, Homo sapiens
gcacctcacaaacaccg

SEQ ID NO: 4419 - DNA, 18 bp, Homo sapiens
tgcacctcacaaacacca

SEQ ID NO: 4420 - DNA, 28 bp, Homo sapiens
gcctcttctgcaaatggatgatatacac

SEQ ID NO: 4421 - DNA, 18 bp, Homo sapiens
cctggagtggatgccttc

SEQ ID NO: 4422 - DNA, 18 bp, Homo sapiens
cctggagtggatgccttt

SEQ ID NO: 4423 - DNA, 19 bp, Homo sapiens
ggacagcagacacctgagc

SEQ ID NO: 4424 - DNA, 23 bp, Homo sapiens
gagcaccttaactatagatggtg

SEQ ID NO: 4425 - DNA, 24 bp, Homo sapiens
tgagcaccttaactatagatggta

SEQ ID NO: 4426 - DNA, 22 bp, Homo sapiens
cttgtcaaggcacagaataatt

SEQ ID NO: 4427 - DNA, 18 bp, Homo sapiens
caggtcaggcacaaacat

SEQ ID NO: 4428 - DNA, 18 bp, Homo sapiens
caggtcaggcacaaacac

SEQ ID NO: 4429 - DNA, 23 bp, Homo sapiens
gaagatgacctgttgagtcagta

SEQ ID NO: 4430 - DNA, 17 bp, Homo sapiens
acaacaggagcacaccg

SEQ ID NO: 4431 - DNA, 18 bp, Homo sapiens
gacaacaggagcacacca

SEQ ID NO: 4432 - DNA, 21 bp, Homo sapiens
gatgcagtccctttttctaaa

SEQ ID NO: 4433 - DNA, 17 bp, Homo sapiens
tatcgctgggtaaaccg

SEQ ID NO: 4434 - DNA, 18 bp, Homo sapiens
gtatcgctgggtaaacca

SEQ ID NO: 4435 - DNA, 22 bp, Homo sapiens
cgactctgaggagatggagtat

SEQ ID NO: 4436 - DNA, 18 bp, Homo sapiens
actcccccaagatcttct

SEQ ID NO: 4437 - DNA, 15 bp, Homo sapiens
cccccaagatcttcc

SEQ ID NO: 4438 - DNA, 16 bp, Homo sapiens
gctcccccgacaaact

SEQ ID NO: 4439 - DNA, 15 bp, Homo sapiens
ccatctgttccgccg

SEQ ID NO: 4440 - DNA, 16 bp, Homo sapiens
tccatctgttccgcca

SEQ ID NO: 4441 - DNA, 18 bp, Homo sapiens
ttacccagcagcgaagac

SEQ ID NO: 4442 - DNA, 17 bp, Homo sapiens
agcttggttgtagccca

SEQ ID NO: 4443 - DNA, 16 bp, Homo sapiens
gcttggttgtagcccg

SEQ ID NO: 4444 - DNA, 21 bp, Homo sapiens
aggccagcctccaaatctttc

SEQ ID NO: 4445 - DNA, 18 bp, Homo sapiens
aaatgttgtcaacgtcca

SEQ ID NO: 4446 - DNA, 17 bp, Homo sapiens
aatgttgtcaacgtccg

SEQ ID NO: 4447 - DNA, 19 bp, Homo sapiens
agtcactggcagcaatgat

SEQ ID NO: 4448 - DNA, 21 bp, Homo sapiens
gtccatcagcaaattgtctct

SEQ ID NO: 4449 - DNA, 21 bp, Homo sapiens
gtccatcagcaaattgtctca

SEQ ID NO: 4450 - DNA, 23 bp, Homo sapiens
ccgatgacctggggacatattag

SEQ ID NO: 4451 - DNA, 19 bp, Homo sapiens
cctttccttgtctgtctgc

SEQ ID NO: 4452 - DNA, 19 bp, Homo sapiens
cctttccttgtctgtctgt

SEQ ID NO: 4453 - DNA, 21 bp, Homo sapiens
gaaggagggggaggaatgact

SEQ ID NO: 4454 - DNA, 20 bp, Homo sapiens
agaggtcagcacttacagtt

SEQ ID NO: 4455 - DNA, 20 bp, Homo sapiens
agaggtcagcacttacagtc

SEQ ID NO: 4456 - DNA, 22 bp, Homo sapiens
caagcaagcatagaccagatat

SEQ ID NO: 4457 - DNA, 26 bp, Homo sapiens
ccattcacatacaaatctttcttact

SEQ ID NO: 4458 - DNA, 26 bp, Homo sapiens
ccattcacatacaaatctttcttacc

SEQ ID NO: 4459 - DNA, 26 bp, Homo sapiens
ccagatgaaacttcttcctggtcatt

SEQ ID NO: 4460 - DNA, 15 bp, Homo sapiens
tggctcaagaccaat

SEQ ID NO: 4461 - DNA, 15 bp, Homo sapiens
tggctcaagaccaag

SEQ ID NO: 4462 - DNA, 18 bp, Homo sapiens
cccacatccttgctgatc

SEQ ID NO: 4463 - DNA, 18 bp, Homo sapiens
ctcagggagggagagaga

SEQ ID NO: 4464 - DNA, 18 bp, Homo sapiens
ctcagggagggagagagt

SEQ ID NO: 4465 - DNA, 19 bp, Homo sapiens
acagctcaggcagaaactg

SEQ ID NO: 4466 - DNA, 17 bp, Homo sapiens
cagcctaggcagcattg

SEQ ID NO: 4467 - DNA, 17 bp, Homo sapiens
cagcctaggcagcattt

SEQ ID NO: 4468 - DNA, 25 bp, Homo sapiens
cctgggttcaaccttctgagtagat

SEQ ID NO: 4469 - DNA, 20 bp, Homo sapiens
tgcaagaggactaagcatga

SEQ ID NO: 4470 - DNA, 19 bp, Homo sapiens
gcaagaggactaagcatgg

SEQ ID NO: 4471 - DNA, 15 bp, Homo sapiens
gcggccttgcactca

SEQ ID NO: 4472 - DNA, 19 bp, Homo sapiens
acgacaggatcctgaatga

SEQ ID NO: 4473 - DNA, 18 bp, Homo sapiens
cgacaggatcctgaatgc

SEQ ID NO: 4474 - DNA, 20 bp, Homo sapiens
cctagctcgtacccacctct

SEQ ID NO: 4475 - DNA, 17 bp, Homo sapiens
gcccccctctctgaaga

SEQ ID NO: 4476 - DNA, 16 bp, Homo sapiens
cccccctctctgaagg

SEQ ID NO: 4477 - DNA, 22 bp, Homo sapiens
ccagttcgtggtatgttcatct

SEQ ID NO: 4478 - DNA, 24 bp, Homo sapiens
catttggctatttttagctctaaa

SEQ ID NO: 4479 - DNA, 25 bp, Homo sapiens
acatttggctatttttagctctaat

SEQ ID NO: 4480 - DNA, 16 bp, Homo sapiens
gcggctgggtttctgt

SEQ ID NO: 4481 - DNA, 13 bp, Homo sapiens
catcccgcgccat

SEQ ID NO: 4482 - DNA, 13 bp, Homo sapiens
catcccgcgccac

SEQ ID NO: 4483 - DNA, 22 bp, Homo sapiens
cctccagagaagaagaagacac

SEQ ID NO: 4484 - DNA, 14 bp, Homo sapiens
ggtcacagccaggc

SEQ ID NO: 4485 - DNA, 15 bp, Homo sapiens
aggtcacagccaggt

SEQ ID NO: 4486 - DNA, 21 bp, Homo sapiens
ccccaggaatatgtaagttga

SEQ ID NO: 4487 - DNA, 15 bp, Homo sapiens
tgggctccatcccac

SEQ ID NO: 4488 - DNA, 15 bp, Homo sapiens
tgggctccatcccat

SEQ ID NO: 4489 - DNA, 24 bp, Homo sapiens
ccaattctttttcttctttcagtt

SEQ ID NO: 4490 - DNA, 24 bp, Homo sapiens
cacagacttgatgtttttgaaagt

SEQ ID NO: 4491 - DNA, 22 bp, Homo sapiens
cagacttgatgtttttgaaagc

SEQ ID NO: 4492 - DNA, 19 bp, Homo sapiens
tgcaaaggaagcaacttca

SEQ ID NO: 4493 - DNA, 30 bp, Homo sapiens
gctgctatttttgttattattattttctac

SEQ ID NO: 4494 - DNA, 30 bp, Homo sapiens
gctgctatttttgttattattattttctat

SEQ ID NO: 4495 - DNA, 20 bp, Homo sapiens
ggccttaccatctccagaaa

SEQ ID NO: 4496 - DNA, 16 bp, Homo sapiens
ccggcttgcacttcac

SEQ ID NO: 4497 - DNA, 16 bp, Homo sapiens
ccggcttgcacttcat

SEQ ID NO: 4498 - DNA, 18 bp, Homo sapiens
ctttgtggccgcagtagt

SEQ ID NO: 4499 - DNA, 20 bp, Homo sapiens
gctcagtcattacctttgcc

SEQ ID NO: 4500 - DNA, 20 bp, Homo sapiens
gctcagtcattacctttgcg

SEQ ID NO: 4501 - DNA, 23 bp, Homo sapiens
actgctccctcccattcatacag

SEQ ID NO: 4502 - DNA, 23 bp, Homo sapiens
ttaattcttttggcacaggtaga

SEQ ID NO: 4503 - DNA, 20 bp, Homo sapiens
attcttttggcacaggtagg

SEQ ID NO: 4504 - DNA, 25 bp, Homo sapiens
tgactggggagaagtgagaactaga

SEQ ID NO: 4505 - DNA, 22 bp, Homo sapiens
ggggccatttattcttcttcac

SEQ ID NO: 4506 - DNA, 22 bp, Homo sapiens
ggggccatttattcttcttcat

SEQ ID NO: 4507 - DNA, 25 bp, Homo sapiens
ggagtggaaggaatggggattaaag

SEQ ID NO: 4508 - DNA, 19 bp, Homo sapiens
tgctggtggctttaaagaa

SEQ ID NO: 4509 - DNA, 19 bp, Homo sapiens
tgctggtggctttaaagac

SEQ ID NO: 4510 - DNA, 19 bp, Homo sapiens
ggcaaaaccccttttattg

SEQ ID NO: 4511 - DNA, 18 bp, Homo sapiens
tccaaaaggacctgacat

SEQ ID NO: 4512 - DNA, 18 bp, Homo sapiens
tccaaaaggacctgacac

SEQ ID NO: 4513 - DNA, 18 bp, Homo sapiens
ggctgcagaatggaattt

SEQ ID NO: 4514 - DNA, 23 bp, Homo sapiens
cctagacaataaagatggtcctc

SEQ ID NO: 4515 - DNA, 23 bp, Homo sapiens
cctagacaataaagatggtcctg

SEQ ID NO: 4516 - DNA, 22 bp, Homo sapiens
ccaactctcttcctcttgtcat

SEQ ID NO: 4517 - DNA, 21 bp, Homo sapiens
atatattgaccgttctcccat

SEQ ID NO: 4518 - DNA, 21 bp, Homo sapiens
atatattgaccgttctcccac

SEQ ID NO: 4519 - DNA, 18 bp, Homo sapiens
gccacctccaaccatatc

SEQ ID NO: 4520 - DNA, 18 bp, Homo sapiens
gaagtcattctgctctgc

SEQ ID NO: 4521 - DNA, 20 bp, Homo sapiens
atgaagtcattctgctctgt

SEQ ID NO: 4522 - DNA, 25 bp, Homo sapiens
tttccatctcctaactcttttctag

SEQ ID NO: 4523 - DNA, 17 bp, Homo sapiens
aaggcaggatgggagtg

SEQ ID NO: 4524 - DNA, 18 bp, Homo sapiens
aaaggcaggatgggagtt

SEQ ID NO: 4525 - DNA, 22 bp, Homo sapiens
cgtcaaagcactaatgtcatgt

SEQ ID NO: 4526 - DNA, 16 bp, Homo sapiens
gcgcaaaaggcaagac

SEQ ID NO: 4527 - DNA, 16 bp, Homo sapiens
gcgcaaaaggcaagat

SEQ ID NO: 4528 - DNA, 21 bp, Homo sapiens
ccttgggacacacatttacag

SEQ ID NO: 4529 - DNA, 22 bp, Homo sapiens
ctcaatgtcgtattcaccttct

SEQ ID NO: 4530 - DNA, 20 bp, Homo sapiens
caatgtcgtattcaccttcc

SEQ ID NO: 4531 - DNA, 24 bp, Homo sapiens
actccaggatttttcaaagattat

SEQ ID NO: 4532 - DNA, 20 bp, Homo sapiens
ctttgaaccttttcaccaca

SEQ ID NO: 4533 - DNA, 19 bp, Homo sapiens
tttgaaccttttcaccacc

SEQ ID NO: 4534 - DNA, 22 bp, Homo sapiens
gagtgaggagggagaaagtaag

SEQ ID NO: 4535 - DNA, 17 bp, Homo sapiens
cacaatcaccacggtct

SEQ ID NO: 4536 - DNA, 16 bp, Homo sapiens
acaatcaccacggtcc

SEQ ID NO: 4537 - DNA, 20 bp, Homo sapiens
ccttctgcatcagcatcttc

SEQ ID NO: 4538 - DNA, 16 bp, Homo sapiens
gggtcggtgcaagagg

SEQ ID NO: 4539 - DNA, 16 bp, Homo sapiens
gggtcggtgcaagaga

SEQ ID NO: 4540 - DNA, 18 bp, Homo sapiens
gcaccttggtgggtttgt

SEQ ID NO: 4541 - DNA, 17 bp, Homo sapiens
ggacgtggacatggagt

SEQ ID NO: 4542 - DNA, 17 bp, Homo sapiens
ggacgtggacatggaga

SEQ ID NO: 4543 - DNA, 15 bp, Homo sapiens
cggcgctcgtaggtg

SEQ ID NO: 4544 - DNA, 17 bp, Homo sapiens
agtggccaagaacacca

SEQ ID NO: 4545 - DNA, 15 bp, Homo sapiens
tggccaagaacaccg

SEQ ID NO: 4546 - DNA, 20 bp, Homo sapiens
ggtatgaggcaaagttcctg

SEQ ID NO: 4547 - DNA, 15 bp, Homo sapiens
ccagcagtatggacg

SEQ ID NO: 4548 - DNA, 17 bp, Homo sapiens
tgccagcagtatggaca

SEQ ID NO: 4549 - DNA, 18 bp, Homo sapiens
ccatccagcctcaggaac

SEQ ID NO: 4550 - DNA, 14 bp, Homo sapiens
gaggctgcgtatcc

SEQ ID NO: 4551 - DNA, 15 bp, Homo sapiens
ggaggctgcgtatct

SEQ ID NO: 4552 - DNA, 21 bp, Homo sapiens
gtagctgtgcagtgacagtgt

SEQ ID NO: 4553 - DNA, 16 bp, Homo sapiens
tggaggctgatgggta

SEQ ID NO: 4554 - DNA, 15 bp, Homo sapiens
ggaggctgatgggtg

SEQ ID NO: 4555 - DNA, 18 bp, Homo sapiens
cgctttgcagccataact

SEQ ID NO: 4556 - DNA, 19 bp, Homo sapiens
agaacgcctatgaggagtg

SEQ ID NO: 4557 - DNA, 20 bp, Homo sapiens
aagaacgcctatgaggagtc

SEQ ID NO: 4558 - DNA, 17 bp, Homo sapiens
ttgggtggcaccatatg

SEQ ID NO: 4559 - DNA, 17 bp, Homo sapiens
atctcctcggctgtctt

SEQ ID NO: 4560 - DNA, 17 bp, Homo sapiens
atctcctcggctgtctc

SEQ ID NO: 4561 - DNA, 18 bp, Homo sapiens
aacctcacctggcatgag

SEQ ID NO: 4562 - DNA, 15 bp, Homo sapiens
cccacagcctgcgat

SEQ ID NO: 4563 - DNA, 15 bp, Homo sapiens
cccacagcctgcgac

SEQ ID NO: 4564 - DNA, 18 bp, Homo sapiens
ccgcttgaggtccacata

SEQ ID NO: 4565 - DNA, 18 bp, Homo sapiens
gcaccttgctgctgtctg

SEQ ID NO: 4566 - DNA, 18 bp, Homo sapiens
gcaccttgctgctgtctc

SEQ ID NO: 4567 - DNA, 19 bp, Homo sapiens
gccctgatcactgcaaaac

SEQ ID NO: 4568 - DNA, 24 bp, Homo sapiens
aggttgtacctgtagcactaagac

SEQ ID NO: 4569 - DNA, 25 bp, Homo sapiens
taggttgtacctgtagcactaagat

SEQ ID NO: 4570 - DNA, 21 bp, Homo sapiens
tgggctcctcagagaaaatat

SEQ ID NO: 4571 - DNA, 21 bp, Homo sapiens
aagataagcctgtcactggtc

SEQ ID NO: 4572 - DNA, 21 bp, Homo sapiens
aagataagcctgtcactggtt

SEQ ID NO: 4573 - DNA, 22 bp, Homo sapiens
caagccagcctaataaacataa

SEQ ID NO: 4574 - DNA, 24 bp, Homo sapiens
tctgtagtcaacaggagaagagac

SEQ ID NO: 4575 - DNA, 24 bp, Homo sapiens
tctgtagtcaacaggagaagagat

SEQ ID NO: 4576 - DNA, 19 bp, Homo sapiens
gctgggttttggtgaagtt

SEQ ID NO: 4577 - DNA, 18 bp, Homo sapiens
ggccactttgcctgaata

SEQ ID NO: 4578 - DNA, 18 bp, Homo sapiens
ggccactttgcctgaatt

SEQ ID NO: 4579 - DNA, 25 bp, Homo sapiens
cgaaatgttcatttttaaagtcaga

SEQ ID NO: 4580 - DNA, 18 bp, Homo sapiens
ccaagatcttcagcaacg

SEQ ID NO: 4581 - DNA, 19 bp, Homo sapiens
accaagatcttcagcaaca

SEQ ID NO: 4582 - DNA, 19 bp, Homo sapiens
tgcaacctccacacaatct

SEQ ID NO: 4583 - DNA, 21 bp, Homo sapiens
ccacatagattcctaagaacg

SEQ ID NO: 4584 - DNA, 22 bp, Homo sapiens
accacatagattcctaagaaca

SEQ ID NO: 4585 - DNA, 21 bp, Homo sapiens
caaacaccatggtttttcttt

SEQ ID NO: 4586 - DNA, 14 bp, Homo sapiens
cactgccatgctcg

SEQ ID NO: 4587 - DNA, 15 bp, Homo sapiens
acactgccatgctca

SEQ ID NO: 4588 - DNA, 17 bp, Homo sapiens
gctggcgcaggaagtag

SEQ ID NO: 4589 - DNA, 16 bp, Homo sapiens
cagacctgcagcttca

SEQ ID NO: 4590 - DNA, 15 bp, Homo sapiens
agacctgcagcttcg

SEQ ID NO: 4591 - DNA, 24 bp, Homo sapiens
tgtaacccatcaactctgtttatc

SEQ ID NO: 4592 - DNA, 17 bp, Homo sapiens
gatgctggcaaagaaca

SEQ ID NO: 4593 - DNA, 16 bp, Homo sapiens
atgctggcaaagaacg

SEQ ID NO: 4594 - DNA, 21 bp, Homo sapiens
caatcatccacctttgtctgt

SEQ ID NO: 4595 - DNA, 14 bp, Homo sapiens
cgctgcagggtcat

SEQ ID NO: 4596 - DNA, 14 bp, Homo sapiens
cgctgcagggtcac

SEQ ID NO: 4597 - DNA, 18 bp, Homo sapiens
cctccccgcagagaatta

SEQ ID NO: 4598 - DNA, 19 bp, Homo sapiens
aatggtccagttccctctc

SEQ ID NO: 4599 - DNA, 20 bp, Homo sapiens
caatggtccagttccctcta

SEQ ID NO: 4600 - DNA, 22 bp, Homo sapiens
tgaagtgtgaatgatgctgata

SEQ ID NO: 4601 - DNA, 19 bp, Homo sapiens
ctgcctcttctgcattaga

SEQ ID NO: 4602 - DNA, 18 bp, Homo sapiens
tgcctcttctgcattagg

SEQ ID NO: 4603 - DNA, 20 bp, Homo sapiens
ccttcactgcctgtttctct

SEQ ID NO: 4604 - DNA, 24 bp, Homo sapiens
tgacagagaatactggaagatatg

SEQ ID NO: 4605 - DNA, 25 bp, Homo sapiens
ctgacagagaatactggaagatatt

SEQ ID NO: 4606 - DNA, 20 bp, Homo sapiens
ccatcttggccatgtttaat

SEQ ID NO: 4607 - DNA, 21 bp, Homo sapiens
cagtgctggaacctgtaagtc

SEQ ID NO: 4608 - DNA, 21 bp, Homo sapiens
cagtgctggaacctgtaagtt

SEQ ID NO: 4609 - DNA, 22 bp, Homo sapiens
tggagtcaaaggttaaaactca

SEQ ID NO: 4610 - DNA, 22 bp, Homo sapiens
ggagccacctatgttctctact

SEQ ID NO: 4611 - DNA, 21 bp, Homo sapiens
gagccacctatgttctctacc

SEQ ID NO: 4612 - DNA, 20 bp, Homo sapiens
tccctctttgctcattcatc

SEQ ID NO: 4613 - DNA, 18 bp, Homo sapiens
gtgtggcaatgaagtccc

SEQ ID NO: 4614 - DNA, 19 bp, Homo sapiens
agtgtggcaatgaagtcct

SEQ ID NO: 4615 - DNA, 24 bp, Homo sapiens
gcagtgctcgttacatgaaagatc

SEQ ID NO: 4616 - DNA, 17 bp, Homo sapiens
agccccttgtcttccat

SEQ ID NO: 4617 - DNA, 17 bp, Homo sapiens
agccccttgtcttccac

SEQ ID NO: 4618 - DNA, 22 bp, Homo sapiens
aaagcagttcgacaaaatctta

SEQ ID NO: 4619 - DNA, 20 bp, Homo sapiens
ccaagcgacagtcatagtct

SEQ ID NO: 4620 - DNA, 19 bp, Homo sapiens
caagcgacagtcatagtcg

SEQ ID NO: 4621 - DNA, 28 bp, Homo sapiens
gtgctgaatgtttgctctgtgtatctac

SEQ ID NO: 4622 - DNA, 15 bp, Homo sapiens
ctcgcagcggtcagt

SEQ ID NO: 4623 - DNA, 14 bp, Homo sapiens
tcgcagcggtcagc

SEQ ID NO: 4624 - DNA, 16 bp, Homo sapiens
gctggcgggaatttct

SEQ ID NO: 4625 - DNA, 20 bp, Homo sapiens
cgaactcttcaaggtggttg

SEQ ID NO: 4626 - DNA, 21 bp, Homo sapiens
ccgaactcttcaaggtggtta

SEQ ID NO: 4627 - DNA, 20 bp, Homo sapiens
ccatgcatgcttcaggtaag

SEQ ID NO: 4628 - DNA, 15 bp, Homo sapiens
tggcactcagggcat

SEQ ID NO: 4629 - DNA, 15 bp, Homo sapiens
tggcactcagggcac

SEQ ID NO: 4630 - DNA, 22 bp, Homo sapiens
ccaaagaggactgacaactgta

SEQ ID NO: 4631 - DNA, 25 bp, Homo sapiens
gggaagttctttcttgtatattcaa

SEQ ID NO: 4632 - DNA, 25 bp, Homo sapiens
gggaagttctttcttgtatattcag

SEQ ID NO: 4633 - DNA, 21 bp, Homo sapiens
tgctgtctttgcctcactaat

SEQ ID NO: 4634 - DNA, 21 bp, Homo sapiens
aatcagcatttttgtcaaaga

SEQ ID NO: 4635 - DNA, 20 bp, Homo sapiens
atcagcatttttgtcaaagg

SEQ ID NO: 4636 - DNA, 20 bp, Homo sapiens
ggcttgtgacctcattgttt

SEQ ID NO: 4637 - DNA, 19 bp, Homo sapiens
aaagcaaaggcacagagag

SEQ ID NO: 4638 - DNA, 19 bp, Homo sapiens
aaagcaaaggcacagagac

SEQ ID NO: 4639 - DNA, 18 bp, Homo sapiens
tgccgtgctgagttaatg

SEQ ID NO: 4640 - DNA, 22 bp, Homo sapiens
gctttatcagagactctgaagc

SEQ ID NO: 4641 - DNA, 22 bp, Homo sapiens
gctttatcagagactctgaagg

SEQ ID NO: 4642 - DNA, 17 bp, Homo sapiens
ccaaggccacggatatc

SEQ ID NO: 4643 - DNA, 19 bp, Homo sapiens
cagtaagctggagagtgga

SEQ ID NO: 4644 - DNA, 18 bp, Homo sapiens
agtaagctggagagtggc

SEQ ID NO: 4645 - DNA, 24 bp, Homo sapiens
tgggaggtggataaggcagataag

SEQ ID NO: 4646 - DNA, 19 bp, Homo sapiens
gtttgtgggttttgtggga

SEQ ID NO: 4647 - DNA, 18 bp, Homo sapiens
tttgtgggttttgtgggg

SEQ ID NO: 4648 - DNA, 25 bp, Homo sapiens
cagagcagctttcaaactttctgaa

SEQ ID NO: 4649 - DNA, 21 bp, Homo sapiens
cctggttagctttaccttacg

SEQ ID NO: 4650 - DNA, 22 bp, Homo sapiens
ccctggttagctttaccttaca

SEQ ID NO: 4651 - DNA, 17 bp, Homo sapiens
cccttgccatccacact

SEQ ID NO: 4652 - DNA, 14 bp, Homo sapiens
ggccttggtctcgc

SEQ ID NO: 4653 - DNA, 15 bp, Homo sapiens
tggccttggtctcgt

SEQ ID NO: 4654 - DNA, 22 bp, Homo sapiens
tgcagatcagcttgaagaacta

SEQ ID NO: 4655 - DNA, 28 bp, Homo sapiens
ctgacctttcctttattaagcatctata

SEQ ID NO: 4656 - DNA, 27 bp, Homo sapiens
tgacctttcctttattaagcatctatt

SEQ ID NO: 4657 - DNA, 20 bp, Homo sapiens
gtgccgctgtttcctcatgt

SEQ ID NO: 4658 - DNA, 19 bp, Homo sapiens
ggctgttgctcctcttatg

SEQ ID NO: 4659 - DNA, 20 bp, Homo sapiens
tggctgttgctcctcttatt

SEQ ID NO: 4660 - DNA, 25 bp, Homo sapiens
ggacctgtcaatcttggtcatctat

SEQ ID NO: 4661 - DNA, 26 bp, Homo sapiens
tcctctcagatagtgtgaatacaata

SEQ ID NO: 4662 - DNA, 25 bp, Homo sapiens
cctctcagatagtgtgaatacaatc

SEQ ID NO: 4663 - DNA, 26 bp, Homo sapiens
caactgaggcaaatactgtgctaact

SEQ ID NO: 4664 - DNA, 19 bp, Homo sapiens
tttcaccgtattagccagg

SEQ ID NO: 4665 - DNA, 20 bp, Homo sapiens
gtttcaccgtattagccaga

SEQ ID NO: 4666 - DNA, 20 bp, Homo sapiens
cccatagtggcctcaatagt

SEQ ID NO: 4667 - DNA, 18 bp, Homo sapiens
tccactgtttttgaacgc

SEQ ID NO: 4668 - DNA, 18 bp, Homo sapiens
tccactgtttttgaacgg

SEQ ID NO: 4669 - DNA, 24 bp, Homo sapiens
taattgcaagaatattgaaagaca

SEQ ID NO: 4670 - DNA, 21 bp, Homo sapiens
gaatctcatgttcaggaaatg

SEQ ID NO: 4671 - DNA, 22 bp, Homo sapiens
cgaatctcatgttcaggaaata

SEQ ID NO: 4672 - DNA, 17 bp, Homo sapiens
gccatggcccataaaac

SEQ ID NO: 4673 - DNA, 22 bp, Homo sapiens
agccactaagctcaaactcttt

SEQ ID NO: 4674 - DNA, 21 bp, Homo sapiens
gccactaagctcaaactcttg

SEQ ID NO: 4675 - DNA, 22 bp, Homo sapiens
ccctaaaaccaaagacgtatgt

SEQ ID NO: 4676 - DNA, 20 bp, Homo sapiens
catggagtcaactcttgagg

SEQ ID NO: 4677 - DNA, 21 bp, Homo sapiens
gcatggagtcaactcttgagt

SEQ ID NO: 4678 - DNA, 20 bp, Homo sapiens
ggctgtgctttgtctgatct

SEQ ID NO: 4679 - DNA, 16 bp, Homo sapiens
ggatccgaccgttgag

SEQ ID NO: 4680 - DNA, 16 bp, Homo sapiens
ggatccgaccgttgaa

SEQ ID NO: 4681 - DNA, 25 bp, Homo sapiens
tcattttgaactcattttttctaga

SEQ ID NO: 4682 - DNA, 18 bp, Homo sapiens
ggtggtcttccagtcctt

SEQ ID NO: 4683 - DNA, 18 bp, Homo sapiens
ggtggtcttccagtcctc

SEQ ID NO: 4684 - DNA, 18 bp, Homo sapiens
ttgctccctgcgagtaag

SEQ ID NO: 4685 - DNA, 17 bp, Homo sapiens
ggcctggtggaagtgat

SEQ ID NO: 4686 - DNA, 17 bp, Homo sapiens
ggcctggtggaagtgac

SEQ ID NO: 4687 - DNA, 23 bp, Homo sapiens
agtgtcaaggtaatctggttttt

SEQ ID NO: 4688 - DNA, 18 bp, Homo sapiens
gcaggcctttctcagaat

SEQ ID NO: 4689 - DNA, 18 bp, Homo sapiens
gcaggcctttctcagaac

SEQ ID NO: 4690 - DNA, 23 bp, Homo sapiens
caggaagagaagaagtcacttgt

SEQ ID NO: 4691 - DNA, 15 bp, Homo sapiens
cagaggctgctccgc

SEQ ID NO: 4692 - DNA, 16 bp, Homo sapiens
acagaggctgctccga

SEQ ID NO: 4693 - DNA, 17 bp, Homo sapiens
gggtttgtgggctcttc

SEQ ID NO: 4694 - DNA, 18 bp, Homo sapiens
tgctggagcaattgagag

SEQ ID NO: 4695 - DNA, 19 bp, Homo sapiens
ctgctggagcaattgagat

SEQ ID NO: 4696 - DNA, 19 bp, Homo sapiens
tcttcccctcgtttctttc

SEQ ID NO: 4697 - DNA, 18 bp, Homo sapiens
acaggtcactgggattgg

SEQ ID NO: 4698 - DNA, 18 bp, Homo sapiens
acaggtcactgggattgt

SEQ ID NO: 4699 - DNA, 24 bp, Homo sapiens
ctggacagtgtttggaaggtcata

SEQ ID NO: 4700 - DNA, 25 bp, Homo sapiens
gcaaatcaagtaaaagatctgtttc

SEQ ID NO: 4701 - DNA, 25 bp, Homo sapiens
gcaaatcaagtaaaagatctgttta

SEQ ID NO: 4702 - DNA, 19 bp, Homo sapiens
ctgcagcagctaaatgtca

SEQ ID NO: 4703 - DNA, 37 bp, Homo sapiens
gcccaagcggaaggtacgactttccggctgaaagccg

SEQ ID NO: 4704 - DNA, 38 bp, Homo sapiens
gcataccttgccagtagcgatgcggcggctgaaagcca

SEQ ID NO: 4705 - DNA, 14 bp, Homo sapiens
gcagcacgaactgc

SEQ ID NO: 4706 - DNA, 23 bp, Homo sapiens
gactaaagttctgagccaatcaa

SEQ ID NO: 4707 - DNA, 22 bp, Homo sapiens
actaaagttctgagccaatcag

SEQ ID NO: 4708 - DNA, 23 bp, Homo sapiens
gccctttgttcctcggtttagag

SEQ ID NO: 4709 - DNA, 18 bp, Homo sapiens
caattgaggtccaggagc

SEQ ID NO: 4710 - DNA, 18 bp, Homo sapiens
caattgaggtccaggagg

SEQ ID NO: 4711 - DNA, 19 bp, Homo sapiens
tggtgcaaacagctcttct

SEQ ID NO: 4712 - DNA, 21 bp, Homo sapiens
actgacccttcacacatttac

SEQ ID NO: 4713 - DNA, 24 bp, Homo sapiens
gtaactgacccttcacacatttat

SEQ ID NO: 4714 - DNA, 20 bp, Homo sapiens
tgagccatcgtgcctagcta

SEQ ID NO: 4715 - DNA, 19 bp, Homo sapiens
cttctaggctctgtggtcc

SEQ ID NO: 4716 - DNA, 19 bp, Homo sapiens
cttctaggctctgtggtca

SEQ ID NO: 4717 - DNA, 16 bp, Homo sapiens
ccacgtgcccatgaag

SEQ ID NO: 4718 - DNA, 23 bp, Homo sapiens
ctctctttcagcatcttgtaaat

SEQ ID NO: 4719 - DNA, 23 bp, Homo sapiens
ctctctttcagcatcttgtaaag

SEQ ID NO: 4720 - DNA, 24 bp, Homo sapiens
tgcagaagaaagaaactttatcac

SEQ ID NO: 4721 - DNA, 18 bp, Homo sapiens
tgtgtccaaagggaccac

SEQ ID NO: 4722 - DNA, 18 bp, Homo sapiens
tgtgtccaaagggaccag

SEQ ID NO: 4723 - DNA, 25 bp, Homo sapiens
gaccccattttcctggaccattaag

SEQ ID NO: 4724 - DNA, 25 bp, Homo sapiens
cctattaagatgagaacctcaacac

SEQ ID NO: 4725 - DNA, 25 bp, Homo sapiens
cctattaagatgagaacctcaacag

SEQ ID NO: 4726 - DNA, 23 bp, Homo sapiens
ggaggtggaagagcattgaaact

SEQ ID NO: 4727 - DNA, 19 bp, Homo sapiens
tgtaaaatgcctgtcacgg

SEQ ID NO: 4728 - DNA, 20 bp, Homo sapiens
gtgtaaaatgcctgtcacga

SEQ ID NO: 4729 - DNA, 25 bp, Homo sapiens
cgatgacattcttggtctgtacact

SEQ ID NO: 4730 - DNA, 15 bp, Homo sapiens
gggcctcaccttggt

SEQ ID NO: 4731 - DNA, 15 bp, Homo sapiens
gggcctcaccttggg

SEQ ID NO: 4732 - DNA, 20 bp, Homo sapiens
gcctccccagattgatgtct

SEQ ID NO: 4733 - DNA, 19 bp, Homo sapiens
catcatggtgttcttgcct

SEQ ID NO: 4734 - DNA, 18 bp, Homo sapiens
atcatggtgttcttgccc

SEQ ID NO: 4735 - DNA, 26 bp, Homo sapiens
cattatctgaaatgtttcattgtaga

SEQ ID NO: 4736 - DNA, 14 bp, Homo sapiens
tgggtggcagtccc

SEQ ID NO: 4737 - DNA, 15 bp, Homo sapiens
gtgggtggcagtcct

SEQ ID NO: 4738 - DNA, 21 bp, Homo sapiens
ggggacaggtatgcatgtcat

SEQ ID NO: 4739 - DNA, 26 bp, Homo sapiens
ggaacttaattgcttgatactatcac

SEQ ID NO: 4740 - DNA, 26 bp, Homo sapiens
ggaacttaattgcttgatactatcat

SEQ ID NO: 4741 - DNA, 20 bp, Homo sapiens
gacaccaccgtcctacactg

SEQ ID NO: 4742 - DNA, 26 bp, Homo sapiens
gtaactaacactcagaagtacatttt

SEQ ID NO: 4743 - DNA, 26 bp, Homo sapiens
gtaactaacactcagaagtacatttg

SEQ ID NO: 4744 - DNA, 24 bp, Homo sapiens
gttgaggctgcagtgagctataat

SEQ ID NO: 4745 - DNA, 16 bp, Homo sapiens
gcagccagtttctccc

SEQ ID NO: 4746 - DNA, 17 bp, Homo sapiens
tgcagccagtttctcct

SEQ ID NO: 4747 - DNA, 21 bp, Homo sapiens
catgaaatgcttccaggtatt

SEQ ID NO: 4748 - DNA, 20 bp, Homo sapiens
gttccaaccagaagagaatg

SEQ ID NO: 4749 - DNA, 21 bp, Homo sapiens
ggttccaaccagaagagaata

SEQ ID NO: 4750 - DNA, 18 bp, Homo sapiens
cttgcccccaacagttag

SEQ ID NO: 4751 - DNA, 20 bp, Homo sapiens
gcaatctctccttcctctcc

SEQ ID NO: 4752 - DNA, 20 bp, Homo sapiens
gcaatctctccttcctctcg

SEQ ID NO: 4753 - DNA, 25 bp, Homo sapiens
acacacacacctccacaaatactaa

SEQ ID NO: 4754 - DNA, 24 bp, Homo sapiens
aaataggtcgttctgacataaaag

SEQ ID NO: 4755 - DNA, 24 bp, Homo sapiens
aaataggtcgttctgacataaaaa

SEQ ID NO: 4756 - DNA, 21 bp, Homo sapiens
cccactccaccatctgtatag

SEQ ID NO: 4757 - DNA, 26 bp, Homo sapiens
aagatcatgatttatcttggttccta

SEQ ID NO: 4758 - DNA, 25 bp, Homo sapiens
agatcatgatttatcttggttcctg

SEQ ID NO: 4759 - DNA, 21 bp, Homo sapiens
ggtggtcagcacatgacttct

SEQ ID NO: 4760 - DNA, 23 bp, Homo sapiens
cctgttaggtgtgttgctttaac

SEQ ID NO: 4761 - DNA, 23 bp, Homo sapiens
cctgttaggtgtgttgctttaat

SEQ ID NO: 4762 - DNA, 26 bp, Homo sapiens
gcttacgccattttctgtcggtattt

SEQ ID NO: 4763 - DNA, 19 bp, Homo sapiens
ccccatggtttgttgttgc

SEQ ID NO: 4764 - DNA, 19 bp, Homo sapiens
ccccatggtttgttgttgt

SEQ ID NO: 4765 - DNA, 24 bp, Homo sapiens
cgacttcagtgaccacacataaca

SEQ ID NO: 4766 - DNA, 18 bp, Homo sapiens
tccgttgttctcagggat

SEQ ID NO: 4767 - DNA, 18 bp, Homo sapiens
tccgttgttctcagggac

SEQ ID NO: 4768 - DNA, 18 bp, Homo sapiens
ggttcctggaggcatgtc

SEQ ID NO: 4769 - DNA, 21 bp, Homo sapiens
acattgcggttattgctagtg

SEQ ID NO: 4770 - DNA, 21 bp, Homo sapiens
acattgcggttattgctagtt

SEQ ID NO: 4771 - DNA, 24 bp, Homo sapiens
cacctgcctctctcaaagaatagc

SEQ ID NO: 4772 - DNA, 23 bp, Homo sapiens
ggaatatttgggtttgtttcacc

SEQ ID NO: 4773 - DNA, 23 bp, Homo sapiens
ggaatatttgggtttgtttcact

SEQ ID NO: 4774 - DNA, 30 bp, Homo sapiens
ctgggactgtctattttctttcattcaacc

SEQ ID NO: 4775 - DNA, 26 bp, Homo sapiens
gctatgaggagaacacaagaatatac

SEQ ID NO: 4776 - DNA, 26 bp, Homo sapiens
gctatgaggagaacacaagaatatat

SEQ ID NO: 4777 - DNA, 25 bp, Homo sapiens
cattccctctgccccttcttagata

SEQ ID NO: 4778 - DNA, 21 bp, Homo sapiens
acctaaactttggtatcaccg

SEQ ID NO: 4779 - DNA, 22 bp, Homo sapiens
cacctaaactttggtatcacca

SEQ ID NO: 4780 - DNA, 26 bp, Homo sapiens
ctcacccgctgatatttgtttaacct

SEQ ID NO: 4781 - DNA, 20 bp, Homo sapiens
ctgtcacaagcaacagaaag

SEQ ID NO: 4782 - DNA, 21 bp, Homo sapiens
tctgtcacaagcaacagaaaa

SEQ ID NO: 4783 - DNA, 24 bp, Homo sapiens
cgaggaggagataactggatgtgt

SEQ ID NO: 4784 - DNA, 25 bp, Homo sapiens
ttcagttctttgcagtaataaacag

SEQ ID NO: 4785 - DNA, 25 bp, Homo sapiens
ttcagttctttgcagtaataaacaa

SEQ ID NO: 4786 - DNA, 26 bp, Homo sapiens
catttgtctgagggttcacttgttga

SEQ ID NO: 4787 - DNA, 17 bp, Homo sapiens
gatgctgggtggatgtt

SEQ ID NO: 4788 - DNA, 17 bp, Homo sapiens
gatgctgggtggatgtc

SEQ ID NO: 4789 - DNA, 19 bp, Homo sapiens
tgtggccctgagaatgtac

SEQ ID NO: 4790 - DNA, 25 bp, Homo sapiens
atctattcacaaacacatgaacaag

SEQ ID NO: 4791 - DNA, 25 bp, Homo sapiens
atctattcacaaacacatgaacaaa

SEQ ID NO: 4792 - DNA, 26 bp, Homo sapiens
gagacacccaagcaaactgaacttac

SEQ ID NO: 4793 - DNA, 24 bp, Homo sapiens
gtttctctccagtatgaattcttt

SEQ ID NO: 4794 - DNA, 24 bp, Homo sapiens
gtttctctccagtatgaattcttc

SEQ ID NO: 4795 - DNA, 25 bp, Homo sapiens
aattcattctggagagaaatcttac

SEQ ID NO: 4796 - DNA, 19 bp, Homo sapiens
tgaaggcacctgtcatcat

SEQ ID NO: 4797 - DNA, 19 bp, Homo sapiens
tgaaggcacctgtcatcaa

SEQ ID NO: 4798 - DNA, 23 bp, Homo sapiens
ctcctggtgggccttttgaaata

SEQ ID NO: 4799 - DNA, 24 bp, Homo sapiens
ttcacttcaagcttccatagttat

SEQ ID NO: 4800 - DNA, 23 bp, Homo sapiens
tcacttcaagcttccatagttac

SEQ ID NO: 4801 - DNA, 29 bp, Homo sapiens
cctcctcttctcatcaatcccaaattagt

SEQ ID NO: 4802 - DNA, 23 bp, Homo sapiens
gaatgagtaagggaagaggaaaa

SEQ ID NO: 4803 - DNA, 23 bp, Homo sapiens
gaatgagtaagggaagaggaaag

SEQ ID NO: 4804 - DNA, 22 bp, Homo sapiens
gctgaattgtctgacggaatct

SEQ ID NO: 4805 - DNA, 19 bp, Homo sapiens
gctcggaaaagccaagaaa

SEQ ID NO: 4806 - DNA, 19 bp, Homo sapiens
gctcggaaaagccaagaag

SEQ ID NO: 4807 - DNA, 27 bp, Homo sapiens
gatccagattttgtcaaagccactaga

SEQ ID NO: 4808 - DNA, 24 bp, Homo sapiens
gcattatacatgtgcagtcacatt

SEQ ID NO: 4809 - DNA, 24 bp, Homo sapiens
gcattatacatgtgcagtcacata

SEQ ID NO: 4810 - DNA, 20 bp, Homo sapiens
ccaccatggctgtgtcttgt

SEQ ID NO: 4811 - DNA, 20 bp, Homo sapiens
ggagtgcttttatggcaaaa

SEQ ID NO: 4812 - DNA, 20 bp, Homo sapiens
ggagtgcttttatggcaaac

SEQ ID NO: 4813 - DNA, 27 bp, Homo sapiens
gctgatagtgcaagttagcaacatagt

SEQ ID NO: 4814 - DNA, 19 bp, Homo sapiens
tccagcaattccacttcca

SEQ ID NO: 4815 - DNA, 18 bp, Homo sapiens
ccagcaattccacttccc

SEQ ID NO: 4816 - DNA, 26 bp, Homo sapiens
agaactagcaaagcacctctgtagaa

SEQ ID NO: 4817 - DNA, 28 bp, Homo sapiens
cattatctagtttctttacttgtcttct

SEQ ID NO: 4818 - DNA, 28 bp, Homo sapiens
cattatctagtttctttacttgtcttcc

SEQ ID NO: 4819 - DNA, 24 bp, Homo sapiens
agcatcttctgtgtccagctaagt

SEQ ID NO: 4820 - DNA, 17 bp, Homo sapiens
tggacgtgggctttttc

SEQ ID NO: 4821 - DNA, 17 bp, Homo sapiens
tggacgtgggctttttt

SEQ ID NO: 4822 - DNA, 18 bp, Homo sapiens
gctgcagccctttttctc

SEQ ID NO: 4823 - DNA, 25 bp, Homo sapiens
agatatccactactcttcttctcaa

SEQ ID NO: 4824 - DNA, 25 bp, Homo sapiens
agatatccactactcttcttctcag

SEQ ID NO: 4825 - DNA, 24 bp, Homo sapiens
cttaagccagtcctgcacaactag

SEQ ID NO: 4826 - DNA, 27 bp, Homo sapiens
gcttcaagaggataaagtaaaacagag

SEQ ID NO: 4827 - DNA, 27 bp, Homo sapiens
gcttcaagaggataaagtaaaacagaa

SEQ ID NO: 4828 - DNA, 29 bp, Homo sapiens
gatataacctgtcactacactggactgaa

SEQ ID NO: 4829 - DNA, 21 bp, Homo sapiens
ggtgggccttttgaaataaac

SEQ ID NO: 4830 - DNA, 22 bp, Homo sapiens
tggtgggccttttgaaataaat

SEQ ID NO: 4831 - DNA, 23 bp, Homo sapiens
cttgaagtgaaggcacctgtcat

SEQ ID NO: 4832 - DNA, 23 bp, Homo sapiens
acaataacccttctaattgcaca

SEQ ID NO: 4833 - DNA, 22 bp, Homo sapiens
caataacccttctaattgcacg

SEQ ID NO: 4834 - DNA, 26 bp, Homo sapiens
gtgttgctgaaatcatggagtctgat

SEQ ID NO: 4835 - DNA, 17 bp, Homo sapiens
cccaccatccacttcct

SEQ ID NO: 4836 - DNA, 17 bp, Homo sapiens
cccaccatccacttccc

SEQ ID NO: 4837 - DNA, 20 bp, Homo sapiens
ctccagcgttggggatgatg

SEQ ID NO: 4838 - DNA, 25 bp, Homo sapiens
gttaaaccttctttatctcctcctt

SEQ ID NO: 4839 - DNA, 25 bp, Homo sapiens
gttaaaccttctttatctcctcctc

SEQ ID NO: 4840 - DNA, 19 bp, Homo sapiens
cgcttcgccttgggatatg

SEQ ID NO: 4841 - DNA, 23 bp, Homo sapiens
cagctacacttcagtctacttag

SEQ ID NO: 4842 - DNA, 23 bp, Homo sapiens
cagctacacttcagtctacttac

SEQ ID NO: 4843 - DNA, 27 bp, Homo sapiens
gagaaggagactggagacagatatgac

SEQ ID NO: 4844 - DNA, 20 bp, Homo sapiens
gtctcggaagcaatgttcta

SEQ ID NO: 4845 - DNA, 19 bp, Homo sapiens
tctcggaagcaatgttctc

SEQ ID NO: 4846 - DNA, 21 bp, Homo sapiens
gcttctgccacccctgtaaat

SEQ ID NO: 4847 - DNA, 19 bp, Homo sapiens
tcgctttgaaacactctgc

SEQ ID NO: 4848 - DNA, 20 bp, Homo sapiens
ctcgctttgaaacactctgt

SEQ ID NO: 4849 - DNA, 22 bp, Homo sapiens
ctgtggcttcaggctttacagt

SEQ ID NO: 4850 - DNA, 18 bp, Homo sapiens
ttggaccctcacatgaaa

SEQ ID NO: 4851 - DNA, 18 bp, Homo sapiens
ttggaccctcacatgaag

SEQ ID NO: 4852 - DNA, 23 bp, Homo sapiens
gccattttccacaataaatattt

SEQ ID NO: 4853 - DNA, 20 bp, Homo sapiens
gctgacttttttgctctttc

SEQ ID NO: 4854 - DNA, 20 bp, Homo sapiens
gctgacttttttgctctttg

SEQ ID NO: 4855 - DNA, 23 bp, Homo sapiens
gccattttccacaataaatattt

SEQ ID NO: 4856 - DNA, 16 bp, Homo sapiens
ggagggaggcaaccac

SEQ ID NO: 4857 - DNA, 16 bp, Homo sapiens
ggagggaggcaaccat

SEQ ID NO: 4858 - DNA, 23 bp, Homo sapiens
tgcccgataaacgtgaggtagaa

SEQ ID NO: 4859 - DNA, 21 bp, Homo sapiens
actgctccaagatagaggtac

SEQ ID NO: 4860 - DNA, 21 bp, Homo sapiens
actgctccaagatagaggtag

SEQ ID NO: 4861 - DNA, 24 bp, Homo sapiens
cagcatttgtgagaggagctgttt

SEQ ID NO: 4862 - DNA, 21 bp, Homo sapiens
tcatcaaaccactcaagctac

SEQ ID NO: 4863 - DNA, 23 bp, Homo sapiens
tttcatcaaaccactcaagctat

SEQ ID NO: 4864 - DNA, 28 bp, Homo sapiens
cactcaaatggaagagtcattggtgaat

SEQ ID NO: 4865 - DNA, 16 bp, Homo sapiens
ccctgtgattggccat

SEQ ID NO: 4866 - DNA, 16 bp, Homo sapiens
ccctgtgattggccac

SEQ ID NO: 4867 - DNA, 17 bp, Homo sapiens
cctgctcgctctgtcac

SEQ ID NO: 4868 - DNA, 22 bp, Homo sapiens
gagctcatgtgcattataaacg

SEQ ID NO: 4869 - DNA, 23 bp, Homo sapiens
agagctcatgtgcattataaact

SEQ ID NO: 4870 - DNA, 22 bp, Homo sapiens
ccgcctactgactacctgtcta

SEQ ID NO: 4871 - DNA, 23 bp, Homo sapiens
actggaaagatgacacatctaca

SEQ ID NO: 4872 - DNA, 22 bp, Homo sapiens
ctggaaagatgacacatctacg

SEQ ID NO: 4873 - DNA, 23 bp, Homo sapiens
gggctacacccaaaggctaaatc

SEQ ID NO: 4874 - DNA, 19 bp, Homo sapiens
tcaccccactctgctatag

SEQ ID NO: 4875 - DNA, 19 bp, Homo sapiens
tcaccccactctgctatac

SEQ ID NO: 4876 - DNA, 27 bp, Homo sapiens
caaaggctgggaagggtatgtatattg

SEQ ID NO: 4877 - DNA, 15 bp, Homo sapiens
gcgcccggatggaat

SEQ ID NO: 4878 - DNA, 15 bp, Homo sapiens
gcgcccggatggaac

SEQ ID NO: 4879 - DNA, 23 bp, Homo sapiens
acgcccactccagttactaaaca

SEQ ID NO: 4880 - DNA, 18 bp, Homo sapiens
cttcttgcccttcagctc

SEQ ID NO: 4881 - DNA, 18 bp, Homo sapiens
cttcttgcccttcagctt

SEQ ID NO: 4882 - DNA, 22 bp, Homo sapiens
cccagttctgagatgtgtatgt

SEQ ID NO: 4883 - DNA, 22 bp, Homo sapiens
ttctcctgaagaattgtaagcc

SEQ ID NO: 4884 - DNA, 23 bp, Homo sapiens
tttctcctgaagaattgtaagca

SEQ ID NO: 4885 - DNA, 30 bp, Homo sapiens
gaagttagccaatcttgtcatcttttcact

SEQ ID NO: 4886 - DNA, 23 bp, Homo sapiens
aatgcaaaatgcaaactgtctaa

SEQ ID NO: 4887 - DNA, 24 bp, Homo sapiens
caatgcaaaatgcaaactgtctat

SEQ ID NO: 4888 - DNA, 24 bp, Homo sapiens
tggagttgtcgtcctgtggataat

SEQ ID NO: 4889 - DNA, 23 bp, Homo sapiens
tctagcagatttgtatcagaacc

SEQ ID NO: 4890 - DNA, 26 bp, Homo sapiens
taatctagcagatttgtatcagaact

SEQ ID NO: 4891 - DNA, 21 bp, Homo sapiens
gcgaccctctctggttaaaca

SEQ ID NO: 4892 - DNA, 26 bp, Homo sapiens
ctctactgtttagaatcgttttcaac

SEQ ID NO: 4893 - DNA, 26 bp, Homo sapiens
ctctactgtttagaatcgttttcaat

SEQ ID NO: 4894 - DNA, 24 bp, Homo sapiens
ccagcggtaattggagcaatctta

SEQ ID NO: 4895 - DNA, 21 bp, Homo sapiens
agaacaactcaaaggtgcaaa

SEQ ID NO: 4896 - DNA, 21 bp, Homo sapiens
agaacaactcaaaggtgcaag

SEQ ID NO: 4897 - DNA, 28 bp, Homo sapiens
acatgacctgttctaactgggagttatg

SEQ ID NO: 4898 - DNA, 22 bp, Homo sapiens
ccatgcacactttaatgtgtac

SEQ ID NO: 4899 - DNA, 23 bp, Homo sapiens
tccatgcacactttaatgtgtat

SEQ ID NO: 4900 - DNA, 26 bp, Homo sapiens
cccaaacacaacaggctagaacaaat

SEQ ID NO: 4901 - DNA, 22 bp, Homo sapiens
tcggtgattggtacaagagtaa

SEQ ID NO: 4902 - DNA, 21 bp, Homo sapiens
cggtgattggtacaagagtag

SEQ ID NO: 4903 - DNA, 25 bp, Homo sapiens
gctggaatggtactcctgagtatgt

SEQ ID NO: 4904 - DNA, 22 bp, Homo sapiens
acatttgctcattctgtactcc

SEQ ID NO: 4905 - DNA, 23 bp, Homo sapiens
cacatttgctcattctgtactct

SEQ ID NO: 4906 - DNA, 25 bp, Homo sapiens
caagagatctggaggtggggattat

SEQ ID NO: 4907 - DNA, 19 bp, Homo sapiens
taccacagcttgctcacat

SEQ ID NO: 4908 - DNA, 19 bp, Homo sapiens
taccacagcttgctcacac

SEQ ID NO: 4909 - DNA, 19 bp, Homo sapiens
tttcccccatttttcagtt

SEQ ID NO: 4910 - DNA, 17 bp, Homo sapiens
ggccctgaacctttcag

SEQ ID NO: 4911 - DNA, 17 bp, Homo sapiens
ggccctgaacctttcac

SEQ ID NO: 4912 - DNA, 29 bp, Homo sapiens
cgaattagtaagttaccagtgacatcagc

SEQ ID NO: 4913 - DNA, 25 bp, Homo sapiens
tgtatcgagagagaaagatagtttg

SEQ ID NO: 4914 - DNA, 26 bp, Homo sapiens
ttgtatcgagagagaaagatagtttt

SEQ ID NO: 4915 - DNA, 26 bp, Homo sapiens
ctccaccaaataccctcatctgttct

SEQ ID NO: 4916 - DNA, 25 bp, Homo sapiens
ctggcatattttgaagtattctctg

SEQ ID NO: 4917 - DNA, 27 bp, Homo sapiens
ctctggcatattttgaagtattctcta

SEQ ID NO: 4918 - DNA, 25 bp, Homo sapiens
ctctggaaagggaaatgtcactcta

SEQ ID NO: 4919 - DNA, 22 bp, Homo sapiens
ctccttgcctcaaatgatttct

SEQ ID NO: 4920 - DNA, 21 bp, Homo sapiens
tccttgcctcaaatgatttcc

SEQ ID NO: 4921 - DNA, 30 bp, Homo sapiens
ttcagtcatactcatggtccaaatctcatt

SEQ ID NO: 4922 - DNA, 20 bp, Homo sapiens
aagcatccagagcctcttat

SEQ ID NO: 4923 - DNA, 19 bp, Homo sapiens
agcatccagagcctcttag

SEQ ID NO: 4924 - DNA, 25 bp, Homo sapiens
gctgtccacctgtcactttcataat

SEQ ID NO: 4925 - DNA, 28 bp, Homo sapiens
gcataactaaactatagtgtacagacac

SEQ ID NO: 4926 - DNA, 28 bp, Homo sapiens
gcataactaaactatagtgtacagacat

SEQ ID NO: 4927 - DNA, 19 bp, Homo sapiens
gacgtggccagccatcttc

SEQ ID NO: 4928 - DNA, 25 bp, Homo sapiens
gagcatagaaacaattttgttccat

SEQ ID NO: 4929 - DNA, 24 bp, Homo sapiens
agcatagaaacaattttgttccac

SEQ ID NO: 4930 - DNA, 27 bp, Homo sapiens
agtgtgtggtttcagcagtactagatt

SEQ ID NO: 4931 - DNA, 20 bp, Homo sapiens
cctgggcaagatggtaaaac

SEQ ID NO: 4932 - DNA, 20 bp, Homo sapiens
cctgggcaagatggtaaaag

SEQ ID NO: 4933 - DNA, 19 bp, Homo sapiens
ctgggctcaggcaatccta

SEQ ID NO: 4934 - DNA, 24 bp, Homo sapiens
cagagtccttcagtaaacttcttt

SEQ ID NO: 4935 - DNA, 24 bp, Homo sapiens
cagagtccttcagtaaacttcttg

SEQ ID NO: 4936 - DNA, 27 bp, Homo sapiens
ccaccttctttcaacccaaattttctc

SEQ ID NO: 4937 - DNA, 26 bp, Homo sapiens
acagcttttacttacctttgatagag

SEQ ID NO: 4938 - DNA, 26 bp, Homo sapiens
acagcttttacttacctttgatagac

SEQ ID NO: 4939 - DNA, 25 bp, Homo sapiens
agctgagtgggagagaagaatacac

SEQ ID NO: 4940 - DNA, 21 bp, Homo sapiens
agcactccataactttaccct

SEQ ID NO: 4941 - DNA, 20 bp, Homo sapiens
gcactccataactttacccg

SEQ ID NO: 4942 - DNA, 34 bp, Homo sapiens
gactacacacaagatcaactaatagaaatactgc

SEQ ID NO: 4943 - DNA, 14 bp, Homo sapiens
accgttgtcctccc

SEQ ID NO: 4944 - DNA, 15 bp, Homo sapiens
gaccgttgtcctcct

SEQ ID NO: 4945 - DNA, 20 bp, Homo sapiens
gcctctagcacgatggatag

SEQ ID NO: 4946 - DNA, 22 bp, Homo sapiens
aaaccttcctacacagaacttc

SEQ ID NO: 4947 - DNA, 22 bp, Homo sapiens
aaaccttcctacacagaacttt

SEQ ID NO: 4948 - DNA, 22 bp, Homo sapiens
ctggtggtggtgagaagaacat

SEQ ID NO: 4949 - DNA, 23 bp, Homo sapiens
ctgagccaccttatctgttaaaa

SEQ ID NO: 4950 - DNA, 22 bp, Homo sapiens
tgagccaccttatctgttaaac

SEQ ID NO: 4951 - DNA, 25 bp, Homo sapiens
cacagggttgttaaccttggtttag

SEQ ID NO: 4952 - DNA, 20 bp, Homo sapiens
acacctgctgactatccaat

SEQ ID NO: 4953 - DNA, 19 bp, Homo sapiens
cacctgctgactatccaac

SEQ ID NO: 4954 - DNA, 24 bp, Homo sapiens
catcgtgatcctgccaagtagaga

SEQ ID NO: 4955 - DNA, 26 bp, Homo sapiens
ggcgaagacaaaattatatttcaact

SEQ ID NO: 4956 - DNA, 26 bp, Homo sapiens
ggcgaagacaaaattatatttcaacg

SEQ ID NO: 4957 - DNA, 23 bp, Homo sapiens
ccaggaagctcaggcaaatttga

SEQ ID NO: 4958 - DNA, 18 bp, Homo sapiens
ctggaaatggttatgggc

SEQ ID NO: 4959 - DNA, 20 bp, Homo sapiens
tactggaaatggttatggga

SEQ ID NO: 4960 - DNA, 24 bp, Homo sapiens
tttataggcgtgaaactaattctc

SEQ ID NO: 4961 - DNA, 18 bp, Homo sapiens
gcctgtggttgtcttccc

SEQ ID NO: 4962 - DNA, 18 bp, Homo sapiens
gcctgtggttgtcttcca

SEQ ID NO: 4963 - DNA, 21 bp, Homo sapiens
acttcctcaggtctgctgtgt

SEQ ID NO: 4964 - DNA, 19 bp, Homo sapiens
ctccaatcccacatttcca

SEQ ID NO: 4965 - DNA, 18 bp, Homo sapiens
tccaatcccacatttccg

SEQ ID NO: 4966 - DNA, 25 bp, Homo sapiens
ccatgactcttcagaacctgtttgt

SEQ ID NO: 4967 - DNA, 19 bp, Homo sapiens
ctgcagaaacgatcagtgt

SEQ ID NO: 4968 - DNA, 18 bp, Homo sapiens
tgcagaaacgatcagtgg

SEQ ID NO: 4969 - DNA, 22 bp, Homo sapiens
tgcttctgtcattctttctgat

SEQ ID NO: 4970 - DNA, 18 bp, Homo sapiens
tgcctggactgtgttctt

SEQ ID NO: 4971 - DNA, 18 bp, Homo sapiens
tgcctggactgtgttctc

SEQ ID NO: 4972 - DNA, 24 bp, Homo sapiens
gaggcagaggtttcagtgagtaga

SEQ ID NO: 4973 - DNA, 18 bp, Homo sapiens
tctcccactgtgttccta

SEQ ID NO: 4974 - DNA, 17 bp, Homo sapiens
ctcccactgtgttcctg

SEQ ID NO: 4975 - DNA, 24 bp, Homo sapiens
tgccagggattggttgcttaatac

SEQ ID NO: 4976 - DNA, 20 bp, Homo sapiens
gctgcaaaaatgaacaacac

SEQ ID NO: 4977 - DNA, 20 bp, Homo sapiens
gctgcaaaaatgaacaacat

SEQ ID NO: 4978 - DNA, 22 bp, Homo sapiens
gaatgcatagctgatctcaaga

SEQ ID NO: 4979 - DNA, 20 bp, Homo sapiens
gactgtcctgattggaatcc

SEQ ID NO: 4980 - DNA, 21 bp, Homo sapiens
tgactgtcctgattggaatct

SEQ ID NO: 4981 - DNA, 23 bp, Homo sapiens
ggcattttggtatcattttgtta

SEQ ID NO: 4982 - DNA, 17 bp, Homo sapiens
catcctcgtgggaagtg

SEQ ID NO: 4983 - DNA, 17 bp, Homo sapiens
catcctcgtgggaagtt

SEQ ID NO: 4984 - DNA, 22 bp, Homo sapiens
ccaacctctgctctctgataat

SEQ ID NO: 4985 - DNA, 17 bp, Homo sapiens
cagcagagcagccttaa

SEQ ID NO: 4986 - DNA, 17 bp, Homo sapiens
cagcagagcagccttag

SEQ ID NO: 4987 - DNA, 19 bp, Homo sapiens
tgatgctggaagcacttct

SEQ ID NO: 4988 - DNA, 21 bp, Homo sapiens
tggatcctgactttgtgaaat

SEQ ID NO: 4989 - DNA, 21 bp, Homo sapiens
tggatcctgactttgtgaaac

SEQ ID NO: 4990 - DNA, 24 bp, Homo sapiens
ggaatctgaaggagacatttttac

SEQ ID NO: 4991 - DNA, 25 bp, Homo sapiens
ccttcaattctgaaaagtagctaat

SEQ ID NO: 4992 - DNA, 25 bp, Homo sapiens
ccttcaattctgaaaagtagctaag

SEQ ID NO: 4993 - DNA, 22 bp, Homo sapiens
tttgaggttgagtgacatgttc

SEQ ID NO: 4994 - DNA, 21 bp, Homo sapiens
ccggaggctagattattacct

SEQ ID NO: 4995 - DNA, 20 bp, Homo sapiens
cggaggctagattattaccg

SEQ ID NO: 4996 - DNA, 24 bp, Homo sapiens
atcccattccctcccttcacataa

SEQ ID NO: 4997 - DNA, 16 bp, Homo sapiens
gcagtcctgccgtact

SEQ ID NO: 4998 - DNA, 16 bp, Homo sapiens
gcagtcctgccgtacc

SEQ ID NO: 4999 - DNA, 25 bp, Homo sapiens
actgctcaactacctggtggataag

SEQ ID NO: 5000 - DNA, 23 bp, Homo sapiens
gaacagttcagatttacaagtgc

SEQ ID NO: 5001 - DNA, 24 bp, Homo sapiens
agaacagttcagatttacaagtgg

SEQ ID NO: 5002 - DNA, 29 bp, Homo sapiens
ccactgttaacatttgttgtatggtcagt

SEQ ID NO: 5003 - DNA, 24 bp, Homo sapiens
gagtgctaacagagtaattaccaa

SEQ ID NO: 5004 - DNA, 24 bp, Homo sapiens
gagtgctaacagagtaattaccag

SEQ ID NO: 5005 - DNA, 27 bp, Homo sapiens
aaggtctcacctggtatgctgtatttt

SEQ ID NO: 5006 - DNA, 17 bp, Homo sapiens
acaccccaacgtcatca

SEQ ID NO: 5007 - DNA, 17 bp, Homo sapiens
acaccccaacgtcatcc

SEQ ID NO: 5008 - DNA, 22 bp, Homo sapiens
aagccttggaaagcgaaactgt

SEQ ID NO: 5009 - DNA, 22 bp, Homo sapiens
gtgagacagcaaacactataca

SEQ ID NO: 5010 - DNA, 21 bp, Homo sapiens
tgagacagcaaacactatacg

SEQ ID NO: 5011 - DNA, 24 bp, Homo sapiens
ttcccgaagagctggaattacagt

SEQ ID NO: 5012 - DNA, 20 bp, Homo sapiens
accatctactatgagcctcc

SEQ ID NO: 5013 - DNA, 22 bp, Homo sapiens
aaaccatctactatgagcctct

SEQ ID NO: 5014 - DNA, 24 bp, Homo sapiens
gtctgttgcccatggatgattaca

SEQ ID NO: 5015 - DNA, 24 bp, Homo sapiens
gaaactagttctgtcttctagcat

SEQ ID NO: 5016 - DNA, 24 bp, Homo sapiens
gaaactagttctgtcttctagcac

SEQ ID NO: 5017 - DNA, 24 bp, Homo sapiens
gggtcacagacttagccagtgata

SEQ ID NO: 5018 - DNA, 19 bp, Homo sapiens
cttcagacaagctgtcctg

SEQ ID NO: 5019 - DNA, 21 bp, Homo sapiens
atcttcagacaagctgtccta

SEQ ID NO: 5020 - DNA, 24 bp, Homo sapiens
gaaacctaattggcccaggtcatc

SEQ ID NO: 5021 - DNA, 23 bp, Homo sapiens
tgatgcacaagagtgtttacttt

SEQ ID NO: 5022 - DNA, 23 bp, Homo sapiens
tgatgcacaagagtgtttacttc

SEQ ID NO: 5023 - DNA, 25 bp, Homo sapiens
gagcttggattaggcaatggtttct

SEQ ID NO: 5024 - DNA, 21 bp, Homo sapiens
gtggctcattaccaatctctt

SEQ ID NO: 5025 - DNA, 21 bp, Homo sapiens
gtggctcattaccaatctctc

SEQ ID NO: 5026 - DNA, 18 bp, Homo sapiens
gggctccatcaacatcac

SEQ ID NO: 5027 - DNA, 16 bp, Homo sapiens
gcaggccccagatgag

SEQ ID NO: 5028 - DNA, 16 bp, Homo sapiens
gcaggccccagatgat

SEQ ID NO: 5029 - DNA, 17 bp, Homo sapiens
ccatcccacccagtcaa

SEQ ID NO: 5030 - DNA, 19 bp, Homo sapiens
gcccagaaagatgagttca

SEQ ID NO: 5031 - DNA, 19 bp, Homo sapiens
gcccagaaagatgagttcg

SEQ ID NO: 5032 - DNA, 24 bp, Homo sapiens
tgtccctttttcagagacatagat

SEQ ID NO: 5033 - DNA, 24 bp, Homo sapiens
aaaccaggatatcagaacatttta

SEQ ID NO: 5034 - DNA, 22 bp, Homo sapiens
accaggatatcagaacattttg

SEQ ID NO: 5035 - DNA, 25 bp, Homo sapiens
ggtcttaggaattatctgacatctt

SEQ ID NO: 5036 - DNA, 18 bp, Homo sapiens
gtgagttttcgtcccact

SEQ ID NO: 5037 - DNA, 17 bp, Homo sapiens
tgagttttcgtcccacg

SEQ ID NO: 5038 - DNA, 25 bp, Homo sapiens
aagtggccttttctaaggggtagaa

SEQ ID NO: 5039 - DNA, 23 bp, Homo sapiens
gctatgtggtttgaaattgttct

SEQ ID NO: 5040 - DNA, 23 bp, Homo sapiens
gctatgtggtttgaaattgttcc

SEQ ID NO: 5041 - DNA, 21 bp, Homo sapiens
ggagcactgggtcctagatgt

SEQ ID NO: 5042 - DNA, 22 bp, Homo sapiens
tcctctccttgtatcttcacat

SEQ ID NO: 5043 - DNA, 22 bp, Homo sapiens
tcctctccttgtatcttcacac

SEQ ID NO: 5044 - DNA, 27 bp, Homo sapiens
gaggtaatcaggtcatgagggtatagt

SEQ ID NO: 5045 - DNA, 17 bp, Homo sapiens
ccatgcaaccaaaccat

SEQ ID NO: 5046 - DNA, 17 bp, Homo sapiens
ccatgcaaccaaaccac

SEQ ID NO: 5047 - DNA, 21 bp, Homo sapiens
cctctcatccctctcatcttt

SEQ ID NO: 5048 - DNA, 22 bp, Homo sapiens
ctgttccaatatctctttcccc

SEQ ID NO: 5049 - DNA, 23 bp, Homo sapiens
tctgttccaatatctctttccct

SEQ ID NO: 5050 - DNA, 23 bp, Homo sapiens
gcaaaccatagcacgcttataca

SEQ ID NO: 5051 - DNA, 30 bp, Homo sapiens
gtctggtgacataaggtattaaattaaatc

SEQ ID NO: 5052 - DNA, 30 bp, Homo sapiens
gtctggtgacataaggtattaaattaaatt

SEQ ID NO: 5053 - DNA, 27 bp, Homo sapiens
aggtgaattacataggaccctttgtgt

SEQ ID NO: 5054 - DNA, 22 bp, Homo sapiens
agacaaattctctcatgtccac

SEQ ID NO: 5055 - DNA, 22 bp, Homo sapiens
agacaaattctctcatgtccat

SEQ ID NO: 5056 - DNA, 24 bp, Homo sapiens
tgtttttccaggaaaaagatattc

SEQ ID NO: 5057 - DNA, 24 bp, Homo sapiens
cgactttctagaggaaatttaggt

SEQ ID NO: 5058 - DNA, 24 bp, Homo sapiens
cgactttctagaggaaatttaggc

SEQ ID NO: 5059 - DNA, 20 bp, Homo sapiens
cccagcagtcccgttgcttt

SEQ ID NO: 5060 - DNA, 22 bp, Homo sapiens
tctacccaggtacttatcatcc

SEQ ID NO: 5061 - DNA, 24 bp, Homo sapiens
tttctacccaggtacttatcatct

SEQ ID NO: 5062 - DNA, 24 bp, Homo sapiens
ggattcactgtgaaagaacagtat

SEQ ID NO: 5063 - DNA, 22 bp, Homo sapiens
gaggtcttgaaatacagggatt

SEQ ID NO: 5064 - DNA, 22 bp, Homo sapiens
gaggtcttgaaatacagggatc

SEQ ID NO: 5065 - DNA, 24 bp, Homo sapiens
tcttgagaggtgtgatcataactt

SEQ ID NO: 5066 - DNA, 21 bp, Homo sapiens
tgtttcccttatgacaacacg

SEQ ID NO: 5067 - DNA, 22 bp, Homo sapiens
ctgtttcccttatgacaacaca

SEQ ID NO: 5068 - DNA, 25 bp, Homo sapiens
agggtcggtcaaactcatgctatat

SEQ ID NO: 5069 - DNA, 23 bp, Homo sapiens
aagaattcacacccaggtttatt

SEQ ID NO: 5070 - DNA, 22 bp, Homo sapiens
agaattcacacccaggtttatc

SEQ ID NO: 5071 - DNA, 24 bp, Homo sapiens
caactcctgagttcaagcagtctg

SEQ ID NO: 5072 - DNA, 21 bp, Homo sapiens
gccacaatttggagttacagg

SEQ ID NO: 5073 - DNA, 21 bp, Homo sapiens
gccacaatttggagttacaga

SEQ ID NO: 5074 - DNA, 23 bp, Homo sapiens
ccaatccagccctcttgtgtttg

SEQ ID NO: 5075 - DNA, 22 bp, Homo sapiens
gaattgcaagtgcttgttttat

SEQ ID NO: 5076 - DNA, 22 bp, Homo sapiens
gaattgcaagtgcttgttttac

SEQ ID NO: 5077 - DNA, 19 bp, Homo sapiens
ccgattccccagtaacaac

SEQ ID NO: 5078 - DNA, 15 bp, Homo sapiens
tgggttggtgggcag

SEQ ID NO: 5079 - DNA, 15 bp, Homo sapiens
tgggttggtgggcaa

SEQ ID NO: 5080 - DNA, 21 bp, Homo sapiens
gtggcagccaatctgagtact

SEQ ID NO: 5081 - DNA, 15 bp, Homo sapiens
gcgaggacgaagggg

SEQ ID NO: 5082 - DNA, 15 bp, Homo sapiens
gcgaggacgaagggc

SEQ ID NO: 5083 - DNA, 21 bp, Homo sapiens
ggaggatgaatggacagacaa

SEQ ID NO: 5084 - DNA, 17 bp, Homo sapiens
ccgacccgaactaaagg

SEQ ID NO: 5085 - DNA, 17 bp, Homo sapiens
ccgacccgaactaaagc

SEQ ID NO: 5086 - DNA, 15 bp, Homo sapiens
cgcgttccccatgtc

SEQ ID NO: 5087 - DNA, 23 bp, Homo sapiens
tcatagatccctacttgtgctaa

SEQ ID NO: 5088 - DNA, 23 bp, Homo sapiens
tcatagatccctacttgtgctac

SEQ ID NO: 5089 - DNA, 23 bp, Homo sapiens
cgcactgttcccttatcgagatt

SEQ ID NO: 5090 - DNA, 15 bp, Homo sapiens
cggctttctggtggg

SEQ ID NO: 5091 - DNA, 16 bp, Homo sapiens
acggctttctggtgga

SEQ ID NO: 5092 - DNA, 16 bp, Homo sapiens
ggctccgaggacgaga

SEQ ID NO: 5093 - DNA, 16 bp, Homo sapiens
accatggtcaccctgg

SEQ ID NO: 5094 - DNA, 17 bp, Homo sapiens
caccatggtcaccctga

SEQ ID NO: 5095 - DNA, 21 bp, Homo sapiens
ggactgaaagcaatgtgagag

SEQ ID NO: 5096 - DNA, 22 bp, Homo sapiens
gccatttatgtagccaaactga

SEQ ID NO: 5097 - DNA, 22 bp, Homo sapiens
gccatttatgtagccaaactgg

SEQ ID NO: 5098 - DNA, 30 bp, Homo sapiens
gcaggttataaagtgtgagagatctgagta

SEQ ID NO: 5099 - DNA, 22 bp, Homo sapiens
atatcgtgggtgagttcattta

SEQ ID NO: 5100 - DNA, 19 bp, Homo sapiens
tcgtgggtgagttcatttt

SEQ ID NO: 5101 - DNA, 20 bp, Homo sapiens
gggtgctgctgatgaaatac

SEQ ID NO: 5102 - DNA, 24 bp, Homo sapiens
tttctgcaaactaattgacagaac

SEQ ID NO: 5103 - DNA, 25 bp, Homo sapiens
ctttctgcaaactaattgacagaat

SEQ ID NO: 5104 - DNA, 25 bp, Homo sapiens
gtcaagtcctttcggaaatgagaca

SEQ ID NO: 5105 - DNA, 17 bp, Homo sapiens
ccaagctgaaaggcaag

SEQ ID NO: 5106 - DNA, 17 bp, Homo sapiens
ccaagctgaaaggcaat

SEQ ID NO: 5107 - DNA, 17 bp, Homo sapiens
cagccagggtggagagt

SEQ ID NO: 5108 - DNA, 23 bp, Homo sapiens
ctccattctcttacccctcttat

SEQ ID NO: 5109 - DNA, 22 bp, Homo sapiens
tccattctcttacccctcttac

SEQ ID NO: 5110 - DNA, 23 bp, Homo sapiens
ttggggatggactcaagatgtgt

SEQ ID NO: 5111 - DNA, 28 bp, Homo sapiens
ccattaattatgagtgctcttacctaaa

SEQ ID NO: 5112 - DNA, 28 bp, Homo sapiens
ccattaattatgagtgctcttacctaag

SEQ ID NO: 5113 - DNA, 24 bp, Homo sapiens
ccaaccactctggtagacgtgtaa

SEQ ID NO: 5114 - DNA, 21 bp, Homo sapiens
agcatagaggacttcctgttt

SEQ ID NO: 5115 - DNA, 21 bp, Homo sapiens
agcatagaggacttcctgttc

SEQ ID NO: 5116 - DNA, 22 bp, Homo sapiens
gtgctgggattacaggcaagag

SEQ ID NO: 5117 - DNA, 22 bp, Homo sapiens
tggtgcttgttaaaatttgctg

SEQ ID NO: 5118 - DNA, 23 bp, Homo sapiens
gtggtgcttgttaaaatttgcta

SEQ ID NO: 5119 - DNA, 30 bp, Homo sapiens
ctaaatcaggtttatttgccatggaagaga

SEQ ID NO: 5120 - DNA, 19 bp, Homo sapiens
tccatgtgtctgctacctc

SEQ ID NO: 5121 - DNA, 19 bp, Homo sapiens
tccatgtgtctgctacctt

SEQ ID NO: 5122 - DNA, 22 bp, Homo sapiens
ctctttcccggcatacctgaat

SEQ ID NO: 5123 - DNA, 23 bp, Homo sapiens
tcaaaattatttcttgctacagg

SEQ ID NO: 5124 - DNA, 24 bp, Homo sapiens
gtcaaaattatttcttgctacaga

SEQ ID NO: 5125 - DNA, 18 bp, Homo sapiens
tcctccagcctctcattc

SEQ ID NO: 5126 - DNA, 16 bp, Homo sapiens
gtggccagggaaacat

SEQ ID NO: 5127 - DNA, 16 bp, Homo sapiens
gtggccagggaaacac

SEQ ID NO: 5128 - DNA, 18 bp, Homo sapiens
ccatggcgaagcaaatat

SEQ ID NO: 5129 - DNA, 19 bp, Homo sapiens
ccaaccgagatcagattga

SEQ ID NO: 5130 - DNA, 18 bp, Homo sapiens
caaccgagatcagattgg

SEQ ID NO: 5131 - DNA, 21 bp, Homo sapiens
tgatgctgattgtggatgata

SEQ ID NO: 5132 - DNA, 26 bp, Homo sapiens
acttaacactactgaactgtacattt

SEQ ID NO: 5133 - DNA, 26 bp, Homo sapiens
acttaacactactgaactgtacattc

SEQ ID NO: 5134 - DNA, 24 bp, Homo sapiens
cacacacgcccctaaacaatagat

SEQ ID NO: 5135 - DNA, 22 bp, Homo sapiens
agcaaaaccttacaaatgtgac

SEQ ID NO: 5136 - DNA, 22 bp, Homo sapiens
agcaaaaccttacaaatgtgaa

SEQ ID NO: 5137 - DNA, 21 bp, Homo sapiens
ttaccacattcattgcatttg

SEQ ID NO: 5138 - DNA, 16 bp, Homo sapiens
ggagcaggatggtgat

SEQ ID NO: 5139 - DNA, 16 bp, Homo sapiens
ggagcaggatggtgac

SEQ ID NO: 5140 - DNA, 24 bp, Homo sapiens
ggaaatatctcgttcttgttctct

SEQ ID NO: 5141 - DNA, 19 bp, Homo sapiens
cttccactcagcttcttgt

SEQ ID NO: 5142 - DNA, 18 bp, Homo sapiens
ttccactcagcttcttgc

SEQ ID NO: 5143 - DNA, 19 bp, Homo sapiens
gtaacgggagcccctacac

SEQ ID NO: 5144 - DNA, 20 bp, Homo sapiens
ccagacttaccgatgtagac

SEQ ID NO: 5145 - DNA, 20 bp, Homo sapiens
ccagacttaccgatgtagat

SEQ ID NO: 5146 - DNA, 15 bp, Homo sapiens
gagggccgcagaggt

SEQ ID NO: 5147 - DNA, 19 bp, Homo sapiens
gcatagccaaggactccac

SEQ ID NO: 5148 - DNA, 19 bp, Homo sapiens
gcatagccaaggactccat

SEQ ID NO: 5149 - DNA, 22 bp, Homo sapiens
aggtgacaggagtccctacaac

SEQ ID NO: 5150 - DNA, 22 bp, Homo sapiens
gcagtcctgaacaaagtagatg

SEQ ID NO: 5151 - DNA, 23 bp, Homo sapiens
cgcagtcctgaacaaagtagata

SEQ ID NO: 5152 - DNA, 22 bp, Homo sapiens
cgtgcatgttttgaaaaatgta

SEQ ID NO: 5153 - DNA, 15 bp, Homo sapiens
cccgagcggacagtg

SEQ ID NO: 5154 - DNA, 15 bp, Homo sapiens
cccgagcggacagtc

SEQ ID NO: 5155 - DNA, 20 bp, Homo sapiens
caactgctggcagaatcttc

SEQ ID NO: 5156 - DNA, 19 bp, Homo sapiens
gtgatggtagacacctggg

SEQ ID NO: 5157 - DNA, 20 bp, Homo sapiens
tgtgatggtagacacctgga

SEQ ID NO: 5158 - DNA, 17 bp, Homo sapiens
ggctgcacggactcttc

SEQ ID NO: 5159 - DNA, 17 bp, Homo sapiens
tcagttgttgtgggctg

SEQ ID NO: 5160 - DNA, 18 bp, Homo sapiens
ctcagttgttgtgggcta

SEQ ID NO: 5161 - DNA, 21 bp, Homo sapiens
gcccacctgcaaggaatagag

SEQ ID NO: 5162 - DNA, 19 bp, Homo sapiens
tctggtgcgtagaattcct

SEQ ID NO: 5163 - DNA, 17 bp, Homo sapiens
tggtgcgtagaattccc

SEQ ID NO: 5164 - DNA, 18 bp, Homo sapiens
acagcagcaacgatctca

SEQ ID NO: 5165 - DNA, 18 bp, Homo sapiens
gagcagcaggtttgaggt

SEQ ID NO: 5166 - DNA, 16 bp, Homo sapiens
gcagcaggtttgaggg

SEQ ID NO: 5167 - DNA, 20 bp, Homo sapiens
acaccacctgaacgtctctt

SEQ ID NO: 5168 - DNA, 16 bp, Homo sapiens
ggctgaaccccgtcct

SEQ ID NO: 5169 - DNA, 15 bp, Homo sapiens
gctgaaccccgtccc

SEQ ID NO: 5170 - DNA, 20 bp, Homo sapiens
ctttttcctgcatcctgtct

SEQ ID NO: 5171 - DNA, 23 bp, Homo sapiens
cagaccccattttacaataaagc

SEQ ID NO: 5172 - DNA, 24 bp, Homo sapiens
tcagaccccattttacaataaagg

SEQ ID NO: 5173 - DNA, 34 bp, Homo sapiens
acctggattctattttcatcccattacataagag

SEQ ID NO: 5174 - DNA, 15 bp, Homo sapiens
ctttgctgctctgcc

SEQ ID NO: 5175 - DNA, 16 bp, Homo sapiens
cctttgctgctctgct

SEQ ID NO: 5176 - DNA, 24 bp, Homo sapiens
ggtctctggtattaagtggaaaca

SEQ ID NO: 5177 - DNA, 18 bp, Homo sapiens
ggctcccaatgttagtgc

SEQ ID NO: 5178 - DNA, 19 bp, Homo sapiens
tggctcccaatgttagtgt

SEQ ID NO: 5179 - DNA, 25 bp, Homo sapiens
ggattggtttgcatttattttagta

SEQ ID NO: 5180 - DNA, 17 bp, Homo sapiens
catgccacccactacca

SEQ ID NO: 5181 - DNA, 16 bp, Homo sapiens
atgccacccactaccg

SEQ ID NO: 5182 - DNA, 18 bp, Homo sapiens
gagcttttgcagccactc

SEQ ID NO: 5183 - DNA, 20 bp, Homo sapiens
tgcgagtcaaatctcaagac

SEQ ID NO: 5184 - DNA, 20 bp, Homo sapiens
tgcgagtcaaatctcaagaa

SEQ ID NO: 5185 - DNA, 18 bp, Homo sapiens
cctattcccggcacttct

SEQ ID NO: 5186 - DNA, 17 bp, Homo sapiens
accagctccagggtgtt

SEQ ID NO: 5187 - DNA, 17 bp, Homo sapiens
accagctccagggtgtc

SEQ ID NO: 5188 - DNA, 23 bp, Homo sapiens
tgaagttttggaatgagactgat

SEQ ID NO: 5189 - DNA, 21 bp, Homo sapiens
cgtctccaggaaaatcataac

SEQ ID NO: 5190 - DNA, 21 bp, Homo sapiens
cgtctccaggaaaatcataat

SEQ ID NO: 5191 - DNA, 25 bp, Homo sapiens
tgagttattgctacttcagaatcat

SEQ ID NO: 5192 - DNA, 23 bp, Homo sapiens
cactttgtaacctaagagatgct

SEQ ID NO: 5193 - DNA, 22 bp, Homo sapiens
actttgtaacctaagagatgcc

SEQ ID NO: 5194 - DNA, 27 bp, Homo sapiens
gagaactctagtgagtctgtccttcaa

SEQ ID NO: 5195 - DNA, 14 bp, Homo sapiens
tgtgggccaggacg

SEQ ID NO: 5196 - DNA, 15 bp, Homo sapiens
ctgtgggccaggacc

SEQ ID NO: 5197 - DNA, 19 bp, Homo sapiens
acccaccaggacctaaaag

SEQ ID NO: 5198 - DNA, 20 bp, Homo sapiens
ccattcaatgcaatacgtca

SEQ ID NO: 5199 - DNA, 19 bp, Homo sapiens
cattcaatgcaatacgtcg

SEQ ID NO: 5200 - DNA, 20 bp, Homo sapiens
cctctccttccagaaccagt

SEQ ID NO: 5201 - DNA, 21 bp, Homo sapiens
cctgatatccttgttcatcat

SEQ ID NO: 5202 - DNA, 21 bp, Homo sapiens
cctgatatccttgttcatcaa

SEQ ID NO: 5203 - DNA, 22 bp, Homo sapiens
tgttacggctgctataatgtgt

SEQ ID NO: 5204 - DNA, 18 bp, Homo sapiens
agaagctgtgtgtctggc

SEQ ID NO: 5205 - DNA, 19 bp, Homo sapiens
cagaagctgtgtgtctggt

SEQ ID NO: 5206 - DNA, 22 bp, Homo sapiens
tgggtagatgtggaatcaatac

SEQ ID NO: 5207 - DNA, 14 bp, Homo sapiens
gcgaggtgagcccg

SEQ ID NO: 5208 - DNA, 15 bp, Homo sapiens
agcgaggtgagccca

SEQ ID NO: 5209 - DNA, 20 bp, Homo sapiens
gggattatcccaggaaagac

SEQ ID NO: 5210 - DNA, 21 bp, Homo sapiens
cttgactgaaaagtctggtca

SEQ ID NO: 5211 - DNA, 20 bp, Homo sapiens
ttgactgaaaagtctggtcg

SEQ ID NO: 5212 - DNA, 22 bp, Homo sapiens
gtttcatggagggctcagaact

SEQ ID NO: 5213 - DNA, 18 bp, Homo sapiens
tgattgctctcctttgcc

SEQ ID NO: 5214 - DNA, 19 bp, Homo sapiens
gtgattgctctcctttgct

SEQ ID NO: 5215 - DNA, 23 bp, Homo sapiens
ccacctgtatctgccatttctct

SEQ ID NO: 5216 - DNA, 26 bp, Homo sapiens
cattatgagggttacaagaatactcc

SEQ ID NO: 5217 - DNA, 27 bp, Homo sapiens
acattatgagggttacaagaatactct

SEQ ID NO: 5218 - DNA, 23 bp, Homo sapiens
gggaaactcacttctgtaggtaa

SEQ ID NO: 5219 - DNA, 18 bp, Homo sapiens
cctgcttcagaggctgac

SEQ ID NO: 5220 - DNA, 18 bp, Homo sapiens
cctgcttcagaggctgat

SEQ ID NO: 5221 - DNA, 24 bp, Homo sapiens
cctcttctggcctttccatacaat

SEQ ID NO: 5222 - DNA, 15 bp, Homo sapiens
gtgccacggtcaggt

SEQ ID NO: 5223 - DNA, 14 bp, Homo sapiens
tgccacggtcaggc

SEQ ID NO: 5224 - DNA, 25 bp, Homo sapiens
gtgcaaccaccacttgtctttagtt

SEQ ID NO: 5225 - DNA, 20 bp, Homo sapiens
caacctcagtggaaagatgc

SEQ ID NO: 5226 - DNA, 21 bp, Homo sapiens
tcaacctcagtggaaagatga

SEQ ID NO: 5227 - DNA, 20 bp, Homo sapiens
gcccatgtgcaaaggtctca

SEQ ID NO: 5228 - DNA, 16 bp, Homo sapiens
ccacttcgggttcctc

SEQ ID NO: 5229 - DNA, 16 bp, Homo sapiens
ccacttcgggttcctg

SEQ ID NO: 5230 - DNA, 17 bp, Homo sapiens
ccctggcttcaacatga

SEQ ID NO: 5231 - DNA, 17 bp, Homo sapiens
gcaacaggacacctgaa

SEQ ID NO: 5232 - DNA, 17 bp, Homo sapiens
gcaacaggacacctgag

SEQ ID NO: 5233 - DNA, 20 bp, Homo sapiens
gagtgacaggaggctgctta

SEQ ID NO: 5234 - DNA, 17 bp, Homo sapiens
gcccagataccccaaaa

SEQ ID NO: 5235 - DNA, 17 bp, Homo sapiens
gcccagataccccaaag

SEQ ID NO: 5236 - DNA, 16 bp, Homo sapiens
gcccagcctgcgtaga

SEQ ID NO: 5237 - DNA, 18 bp, Homo sapiens
cctctgaggcctgagaaa

SEQ ID NO: 5238 - DNA, 18 bp, Homo sapiens
cctctgaggcctgagaag

SEQ ID NO: 5239 - DNA, 22 bp, Homo sapiens
gtcctgattcctcatttctttc

SEQ ID NO: 5240 - DNA, 16 bp, Homo sapiens
cctggggcaggtacag

SEQ ID NO: 5241 - DNA, 16 bp, Homo sapiens
cctggggcaggtacaa

SEQ ID NO: 5242 - DNA, 19 bp, Homo sapiens
ccatccactgcttgaaaag

SEQ ID NO: 5243 - DNA, 18 bp, Homo sapiens
cacattcacggtcacctt

SEQ ID NO: 5244 - DNA, 18 bp, Homo sapiens
cacattcacggtcacctc

SEQ ID NO: 5245 - DNA, 16 bp, Homo sapiens
cattgcccgagctcaa

SEQ ID NO: 5246 - DNA, 17 bp, Homo sapiens
gtccttgcaagtatccg

SEQ ID NO: 5247 - DNA, 18 bp, Homo sapiens
ggtccttgcaagtatcca

SEQ ID NO: 5248 - DNA, 22 bp, Homo sapiens
gcactacagctgagtccttttc

SEQ ID NO: 5249 - DNA, 18 bp, Homo sapiens
acttctggggcttaggaa

SEQ ID NO: 5250 - DNA, 18 bp, Homo sapiens
acttctggggcttaggac

SEQ ID NO: 5251 - DNA, 18 bp, Homo sapiens
ttcaccgggaactcttgt

SEQ ID NO: 5252 - DNA, 22 bp, Homo sapiens
atttacagaagctgcaagaact

SEQ ID NO: 5253 - DNA, 18 bp, Homo sapiens
acagaagctgcaagaacg

SEQ ID NO: 5254 - DNA, 28 bp, Homo sapiens
cattttctgtttctggatctggcagtag

SEQ ID NO: 5255 - DNA, 21 bp, Homo sapiens
agcaagaaccagtgataggtt

SEQ ID NO: 5256 - DNA, 20 bp, Homo sapiens
gcaagaaccagtgataggtc

SEQ ID NO: 5257 - DNA, 22 bp, Homo sapiens
cctgttggcatgcttgatgatg

SEQ ID NO: 5258 - DNA, 21 bp, Homo sapiens
aggtttcttggaggaagagat

SEQ ID NO: 5259 - DNA, 21 bp, Homo sapiens
aggtttcttggaggaagagac

SEQ ID NO: 5260 - DNA, 17 bp, Homo sapiens
gcactgcacccagtgag

SEQ ID NO: 5261 - DNA, 21 bp, Homo sapiens
tgtgtatatccacggcattat

SEQ ID NO: 5262 - DNA, 21 bp, Homo sapiens
tgtgtatatccacggcattaa

SEQ ID NO: 5263 - DNA, 18 bp, Homo sapiens
tgccctcacccaatattc

SEQ ID NO: 5264 - DNA, 20 bp, Homo sapiens
tcagacacacaggacacatg

SEQ ID NO: 5265 - DNA, 21 bp, Homo sapiens
ttcagacacacaggacacatc

SEQ ID NO: 5266 - DNA, 18 bp, Homo sapiens
cccttctgctcccagaac

SEQ ID NO: 5267 - DNA, 21 bp, Homo sapiens
ccgttataatcgaagggacac

SEQ ID NO: 5268 - DNA, 22 bp, Homo sapiens
tccgttataatcgaagggacat

SEQ ID NO: 5269 - DNA, 24 bp, Homo sapiens
gcttctccactttctcacatcagt

SEQ ID NO: 5270 - DNA, 22 bp, Homo sapiens
aacagaaaacgaagtgatcatc

SEQ ID NO: 5271 - DNA, 23 bp, Homo sapiens
taacagaaaacgaagtgatcatt

SEQ ID NO: 5272 - DNA, 21 bp, Homo sapiens
agttcaagacgggtcatattc

SEQ ID NO: 5273 - DNA, 21 bp, Homo sapiens
cctgttgactgactcataggg

SEQ ID NO: 5274 - DNA, 22 bp, Homo sapiens
tcctgttgactgactcatagga

SEQ ID NO: 5275 - DNA, 22 bp, Homo sapiens
ttggccacatgttctatctcta

SEQ ID NO: 5276 - DNA, 19 bp, Homo sapiens
aaagcataggatggggaca

SEQ ID NO: 5277 - DNA, 17 bp, Homo sapiens
agcataggatggggacg

SEQ ID NO: 5278 - DNA, 22 bp, Homo sapiens
cctgggtgacagagtgagattt

SEQ ID NO: 5279 - DNA, 21 bp, Homo sapiens
gtgagtgtgattttgctcaac

SEQ ID NO: 5280 - DNA, 22 bp, Homo sapiens
tgtgagtgtgattttgctcaaa

SEQ ID NO: 5281 - DNA, 22 bp, Homo sapiens
cccaaacccccagagaataagt

SEQ ID NO: 5282 - DNA, 17 bp, Homo sapiens
catggtgaccccacatt

SEQ ID NO: 5283 - DNA, 17 bp, Homo sapiens
catggtgaccccacatc

SEQ ID NO: 5284 - DNA, 23 bp, Homo sapiens
cccacacagcatgctttctgaat

SEQ ID NO: 5285 - DNA, 21 bp, Homo sapiens
gttgggataggcttgttttgt

SEQ ID NO: 5286 - DNA, 20 bp, Homo sapiens
ttgggataggcttgttttgg

SEQ ID NO: 5287 - DNA, 24 bp, Homo sapiens
gcctccctgtgaacaaactaaagt

SEQ ID NO: 5288 - DNA, 17 bp, Homo sapiens
tccctgaggtgctgaag

SEQ ID NO: 5289 - DNA, 17 bp, Homo sapiens
tccctgaggtgctgaat

SEQ ID NO: 5290 - DNA, 25 bp, Homo sapiens
ggctggttctggcttcttttatctc

SEQ ID NO: 5291 - DNA, 20 bp, Homo sapiens
catcttcatcatcaagggag

SEQ ID NO: 5292 - DNA, 20 bp, Homo sapiens
catcttcatcatcaagggat

SEQ ID NO: 5293 - DNA, 22 bp, Homo sapiens
tgttttcctccctcagatatct

SEQ ID NO: 5294 - DNA, 18 bp, Homo sapiens
cctcaaaggaaaaggctt

SEQ ID NO: 5295 - DNA, 18 bp, Homo sapiens
cctcaaaggaaaaggctc

SEQ ID NO: 5296 - DNA, 18 bp, Homo sapiens
gcggaccatgtgtcaact

SEQ ID NO: 5297 - DNA, 17 bp, Homo sapiens
ccccgcagagaattacc

SEQ ID NO: 5298 - DNA, 17 bp, Homo sapiens
ccccgcagagaattacg

SEQ ID NO: 5299 - DNA, 16 bp, Homo sapiens
acgtcgctgtcgaagc

SEQ ID NO: 5300 - DNA, 20 bp, Homo sapiens
gctcgtagttgtgtctgcat

SEQ ID NO: 5301 - DNA, 20 bp, Homo sapiens
gctcgtagttgtgtctgcac

SEQ ID NO: 5302 - DNA, 20 bp, Homo sapiens
cgcttcctggagagatacat

SEQ ID NO: 5303 - DNA, 14 bp, Homo sapiens
ctccacttggcagg

SEQ ID NO: 5304 - DNA, 15 bp, Homo sapiens
gctccacttggcaga

SEQ ID NO: 5305 - DNA, 20 bp, Homo sapiens
caccaacctgatccgtaatg

SEQ ID NO: 5306 - DNA, 25 bp, Homo sapiens
tcctagaacatacaacagttttagc

SEQ ID NO: 5307 - DNA, 25 bp, Homo sapiens
tcctagaacatacaacagttttagt

SEQ ID NO: 5308 - DNA, 25 bp, Homo sapiens
gtgcctagcagatgcccaataaata

SEQ ID NO: 5309 - DNA, 25 bp, Homo sapiens
gagaaagtcctctatgaactgataa

SEQ ID NO: 5310 - DNA, 25 bp, Homo sapiens
gagaaagtcctctatgaactgatag

SEQ ID NO: 5311 - DNA, 28 bp, Homo sapiens
ccccgtctttcttatatgaagggtagaa

SEQ ID NO: 5312 - DNA, 25 bp, Homo sapiens
agaacacaaaatttctgtgatacac

SEQ ID NO: 5313 - DNA, 26 bp, Homo sapiens
aagaacacaaaatttctgtgatacat

SEQ ID NO: 5314 - DNA, 19 bp, Homo sapiens
gatcctcccgggctcaagt

SEQ ID NO: 5315 - DNA, 17 bp, Homo sapiens
gccctctgcacaccttc

SEQ ID NO: 5316 - DNA, 17 bp, Homo sapiens
gccctctgcacaccttt

SEQ ID NO: 5317 - DNA, 21 bp, Homo sapiens
ggtaggaggatctgcagttgt

SEQ ID NO: 5318 - DNA, 21 bp, Homo sapiens
gagaccagtctgacttacact

SEQ ID NO: 5319 - DNA, 20 bp, Homo sapiens
agaccagtctgacttacacc

SEQ ID NO: 5320 - DNA, 19 bp, Homo sapiens
gcccggccttcctagtatt

SEQ ID NO: 5321 - DNA, 16 bp, Homo sapiens
aggacttccgtgtctt

SEQ ID NO: 5322 - DNA, 16 bp, Homo sapiens
aggacttccgtgtctc

SEQ ID NO: 5323 - DNA, 20 bp, Homo sapiens
acagatgccagcaatacaga

SEQ ID NO: 5324 - DNA, 14 bp, Homo sapiens
cagctcacgcagcg

SEQ ID NO: 5325 - DNA, 15 bp, Homo sapiens
tcagctcacgcagca

SEQ ID NO: 5326 - DNA, 23 bp, Homo sapiens
cttgttggagtgtgtgaataaga

SEQ ID NO: 5327 - DNA, 15 bp, Homo sapiens
ccgcagaggtgtggg

SEQ ID NO: 5328 - DNA, 15 bp, Homo sapiens
ccgcagaggtgtggt

SEQ ID NO: 5329 - DNA, 18 bp, Homo sapiens
cattttgcggtggaaatg

SEQ ID NO: 5330 - DNA, 21 bp, Homo sapiens
acgagaatcttctcctacacg

SEQ ID NO: 5331 - DNA, 21 bp, Homo sapiens
acgagaatcttctcctacaca

SEQ ID NO: 5332 - DNA, 24 bp, Homo sapiens
gtgtgacccactcttgaaagacat

SEQ ID NO: 5333 - DNA, 30 bp, Homo sapiens
tcctccgcgatgccgatgacctgcagaatc

SEQ ID NO: 5334 - DNA, 30 bp, Homo sapiens
tcctccgcgatgccgatgacctgcagaatt

SEQ ID NO: 5335 - DNA, 22 bp, Homo sapiens
tcgcgggccccggcctggtaca

SEQ ID NO: 5336 - DNA, 16 bp, Homo sapiens
gccggcactctcttcc

SEQ ID NO: 5337 - DNA, 16 bp, Homo sapiens
gccggcactctcttct

SEQ ID NO: 5338 - DNA, 19 bp, Homo sapiens
cagagggacaagcagatgt

SEQ ID NO: 5339 - DNA, 22 bp, Homo sapiens
acagatccatttcatctaggtc

SEQ ID NO: 5340 - DNA, 22 bp, Homo sapiens
acagatccatttcatctaggtg

SEQ ID NO: 5341 - DNA, 19 bp, Homo sapiens
ggctctgggaatttcacat

SEQ ID NO: 5342 - DNA, 18 bp, Homo sapiens
agaaggtgggatccaaac

SEQ ID NO: 5343 - DNA, 18 bp, Homo sapiens
agaaggtgggatccaaat

SEQ ID NO: 5344 - DNA, 20 bp, Homo sapiens
agaaaccatcatgctgaggt

SEQ ID NO: 5345 - DNA, 20 bp, Homo sapiens
aaaccaagactctggcaaat

SEQ ID NO: 5346 - DNA, 19 bp, Homo sapiens
aaccaagactctggcaaac

SEQ ID NO: 5347 - DNA, 20 bp, Homo sapiens
ttcccagctgacccagttct

SEQ ID NO: 5348 - DNA, 16 bp, Homo sapiens
ctcgggaccagtccag

SEQ ID NO: 5349 - DNA, 16 bp, Homo sapiens
ctcgggaccagtccaa

SEQ ID NO: 5350 - DNA, 16 bp, Homo sapiens
ccgacagccgaggaga

SEQ ID NO: 5351 - DNA, 15 bp, Homo sapiens
agggatccgcaaagc

SEQ ID NO: 5352 - DNA, 16 bp, Homo sapiens
cagggatccgcaaaga

SEQ ID NO: 5353 - DNA, 20 bp, Homo sapiens
tctttctgccaggtacatca

SEQ ID NO: 5354 - DNA, 14 bp, Homo sapiens
ctgctggccgtcct

SEQ ID NO: 5355 - DNA, 13 bp, Homo sapiens
tgctggccgtcca

SEQ ID NO: 5356 - DNA, 19 bp, Homo sapiens
actcacgcttgctttgact

SEQ ID NO: 5357 - DNA, 18 bp, Homo sapiens
gtcgtcctgctgatttcc

SEQ ID NO: 5358 - DNA, 17 bp, Homo sapiens
tcgtcctgctgatttcg

SEQ ID NO: 5359 - DNA, 17 bp, Homo sapiens
ggaaggccgggatactc

SEQ ID NO: 5360 - DNA, 24 bp, Homo sapiens
tcctgcactgtatgatatatgtga

SEQ ID NO: 5361 - DNA, 23 bp, Homo sapiens
cctgcactgtatgatatatgtgg

SEQ ID NO: 5362 - DNA, 26 bp, Homo sapiens
caaaagtcaacaaatgtgtttacata

SEQ ID NO: 5363 - DNA, 25 bp, Homo sapiens
ctggagtaataacaggaatactgtc

SEQ ID NO: 5364 - DNA, 25 bp, Homo sapiens
ctggagtaataacaggaatactgtg

SEQ ID NO: 5365 - DNA, 25 bp, Homo sapiens
cactgcaagtctgtctcacatagga

SEQ ID NO: 5366 - DNA, 22 bp, Homo sapiens
agctgagggaacaatattaacg

SEQ ID NO: 5367 - DNA, 23 bp, Homo sapiens
aagctgagggaacaatattaaca

SEQ ID NO: 5368 - DNA, 21 bp, Homo sapiens
gccacctgggaaaggctaaat

SEQ ID NO: 5369 - DNA, 18 bp, Homo sapiens
gtgatggatgccactgtc

SEQ ID NO: 5370 - DNA, 17 bp, Homo sapiens
tgatggatgccactgtg

SEQ ID NO: 5371 - DNA, 23 bp, Homo sapiens
cctgagttttttgacacatctct

SEQ ID NO: 5372 - DNA, 15 bp, Homo sapiens
tgcccccagccagaa

SEQ ID NO: 5373 - DNA, 15 bp, Homo sapiens
tgcccccagccagag

SEQ ID NO: 5374 - DNA, 16 bp, Homo sapiens
ggccctccaggatctg

SEQ ID NO: 5375 - DNA, 16 bp, Homo sapiens
ccgccttgcagatgat

SEQ ID NO: 5376 - DNA, 16 bp, Homo sapiens
ccgccttgcagatgac

SEQ ID NO: 5377 - DNA, 19 bp, Homo sapiens
ggagctggccattagaatc

SEQ ID NO: 5378 - DNA, 18 bp, Homo sapiens
cggtgtcagcacctttga

SEQ ID NO: 5379 - DNA, 17 bp, Homo sapiens
ggtgtcagcacctttgg

SEQ ID NO: 5380 - DNA, 16 bp, Homo sapiens
cccccaagcaaccaca

SEQ ID NO: 5381 - DNA, 26 bp, Homo sapiens
tgggatgaattcttcaatgataagat

SEQ ID NO: 5382 - DNA, 26 bp, Homo sapiens
tgggatgaattcttcaatgataagaa

SEQ ID NO: 5383 - DNA, 17 bp, Homo sapiens
tgctggtgcctgtacct

SEQ ID NO: 5384 - DNA, 17 bp, Homo sapiens
cctgtggtcgccatcaa

SEQ ID NO: 5385 - DNA, 17 bp, Homo sapiens
cctgtggtcgccatcat

SEQ ID NO: 5386 - DNA, 23 bp, Homo sapiens
ttcaggctgttcagacagtagtg

SEQ ID NO: 5387 - DNA, 22 bp, Homo sapiens
gatttgattggagtccaggaaa

SEQ ID NO: 5388 - DNA, 22 bp, Homo sapiens
gatttgattggagtccaggaat

SEQ ID NO: 5389 - DNA, 22 bp, Homo sapiens
ctgctcccagctccagtttatc

SEQ ID NO: 5390 - DNA, 17 bp, Homo sapiens
gggccatttctgctgta

SEQ ID NO: 5391 - DNA, 17 bp, Homo sapiens
gggccatttctgctgtt

SEQ ID NO: 5392 - DNA, 24 bp, Homo sapiens
ccagaccccaactcagtagtagat

SEQ ID NO: 5393 - DNA, 16 bp, Homo sapiens
ctcttctcgccccaga

SEQ ID NO: 5394 - DNA, 16 bp, Homo sapiens
ctcttctcgccccagt

SEQ ID NO: 5395 - DNA, 24 bp, Homo sapiens
agaacacaggcttacacgcttttc

SEQ ID NO: 5396 - DNA, 18 bp, Homo sapiens
gtggcttcgtcatgtagg

SEQ ID NO: 5397 - DNA, 18 bp, Homo sapiens
gtggcttcgtcatgtagc

SEQ ID NO: 5398 - DNA, 25 bp, Homo sapiens
cgtgtaagcctgtgttctttctgaa

SEQ ID NO: 5399 - DNA, 22 bp, Homo sapiens
aaaggtgcaaaacatccaattc

SEQ ID NO: 5400 - DNA, 23 bp, Homo sapiens
gaaaggtgcaaaacatccaattt

SEQ ID NO: 5401 - DNA, 22 bp, Homo sapiens
cccaggctagtcttgaacttct

SEQ ID NO: 5402 - DNA, 22 bp, Homo sapiens
actttcgtcctcttcataccta

SEQ ID NO: 5403 - DNA, 21 bp, Homo sapiens
ctttcgtcctcttcatacctg

SEQ ID NO: 5404 - DNA, 24 bp, Homo sapiens
ggggttcactcttggtaccttctt

SEQ ID NO: 5405 - DNA, 22 bp, Homo sapiens
gccatgagacataacatgcttc

SEQ ID NO: 5406 - DNA, 22 bp, Homo sapiens
gccatgagacataacatgcttt

SEQ ID NO: 5407 - DNA, 25 bp, Homo sapiens
cggcttaaggcagaacatttagaga

SEQ ID NO: 5408 - DNA, 20 bp, Homo sapiens
ggacagtggtgctagtagtt

SEQ ID NO: 5409 - DNA, 20 bp, Homo sapiens
ggacagtggtgctagtagtc

SEQ ID NO: 5410 - DNA, 23 bp, Homo sapiens
accctgaccactctggaacatac

SEQ ID NO: 5411 - DNA, 19 bp, Homo sapiens
cttccagaaagctctggga

SEQ ID NO: 5412 - DNA, 17 bp, Homo sapiens
tccagaaagctctgggg

SEQ ID NO: 5413 - DNA, 25 bp, Homo sapiens
caggtcaacagagcctacgaataat

SEQ ID NO: 5414 - DNA, 201 bp, Homo sapiens
aatctgccagccgacaccaggggacaacacggtcttctgggtgacctcaccttggagagcttcaggggtgcctcctgactgactccagagaggtcggcctygttgctgaagatcttggtgatgcccagattcctaaggactctcttgagtttgtaggttccagaaatggacagtttgggaaaatgtagattgatagacctg

SEQ ID NO: 5415 - DNA, 18 bp, Homo sapiens
ctaaggtcttcagcaatg

SEQ ID NO: 5416 - DNA, 18 bp, Homo sapiens
ctaaggtcttcagcaata
